US008052968B2

(12) United States Patent
Chen et al.

(10) Patent No.: US 8,052,968 B2
(45) Date of Patent: Nov. 8, 2011

(54) MODIFIED VACCINIA VIRUS STRAINS FOR USE IN DIAGNOSTIC AND THERAPEUTIC METHODS

(75) Inventors: Nanhai Chen, San Diego, CA (US); Alexa Frentzen, San Diego, CA (US); Aladar A. Szalay, Highland, CA (US); Yong A. Yu, San Diego, CA (US); Qian Zhang, San Diego, CA (US)

(73) Assignee: Genelux Corporation, San Diego, CA (US)

( * ) Notice: Subject to any disclaimer, the term of this patent is extended or adjusted under 35 U.S.C. 154(b) by 254 days.

(21) Appl. No.: 11/975,090

(22) Filed: Oct. 16, 2007

(65) Prior Publication Data
US 2009/0053244 A1  Feb. 26, 2009

Related U.S. Application Data

(60) Provisional application No. 60/852,390, filed on Oct. 16, 2006, provisional application No. 60/933,050, filed on Jun. 4, 2007, provisional application No. 60/950,587, filed on Jul. 18, 2007, provisional application No. 60/994,794, filed on Sep. 21, 2007.

(51) Int. Cl.
*A64K 39/44* (2006.01)
*A64K 39/275* (2006.01)
*C12N 15/39* (2006.01)
*A61N 48/00* (2006.01)

(52) U.S. Cl. ............... 424/93.21; 424/232.1; 435/320.1

(58) Field of Classification Search ............... 435/320.1; 424/135.1
See application file for complete search history.

(56) References Cited

U.S. PATENT DOCUMENTS

| | | | |
|---|---|---|---|
| 3,961,286 A | 6/1976 | Kim | 332/144 |
| 4,603,112 A | 7/1986 | Paoletti et al. | 435/235.1 |
| 4,722,848 A | 2/1988 | Paoletti et al. | 424/199.1 |
| 4,769,330 A | 9/1988 | Paoletti et al. | 435/463 |
| 4,912,199 A | 3/1990 | Lown et al. | 530/331 |
| 4,980,285 A | 12/1990 | Sano et al. | 435/108 |
| 5,110,587 A | 5/1992 | Paoletti et al. | 435/235.1 |
| 5,155,020 A | 10/1992 | Paoletti | 435/69.1 |
| 5,179,078 A | 1/1993 | Rollins et al. | 514/2 |
| 5,221,623 A | 6/1993 | Legocki et al. | 435/252.3 |
| 5,364,773 A | 11/1994 | Paoletti et al. | 435/69.1 |
| 5,368,855 A | 11/1994 | Boyle et al. | 435/320.1 |
| 5,378,457 A | 1/1995 | Paoletti et al. | 424/205.1 |
| 5,494,807 A | 2/1996 | Paoletti | 435/69.3 |
| 5,631,150 A | 5/1997 | Harkki et al. | 435/105 |
| 5,650,135 A | 7/1997 | Contag et al. | 424/9.1 |
| 5,693,533 A | 12/1997 | Raney et al. | 435/366 |
| 5,707,928 A | 1/1998 | Baker | 504/139 |
| 5,710,137 A | 1/1998 | Fisher | 514/44 |
| 5,718,902 A | 2/1998 | Yilma et al. | 424/211.1 |
| 5,719,054 A | 2/1998 | Boursnell et al. | 435/320.1 |
| 5,750,396 A | 5/1998 | Yan et al. | 435/357 |
| 5,759,828 A | 6/1998 | Tal et al. | 435/69.1 |
| 5,833,975 A | 11/1998 | Paoletti et al. | 424/93.2 |
| 5,861,290 A | 1/1999 | Goldsmith et al. | 435/456 |
| 5,866,131 A | 2/1999 | Ramshaw et al. | 424/186.1 |
| 5,888,783 A | 3/1999 | Tomita et al. | 435/115 |
| 5,919,670 A | 7/1999 | Okamoto et al. | 435/106 |
| 5,976,796 A | 11/1999 | Szalay et al. | 435/6 |
| 6,007,806 A | 12/1999 | Lathe et al. | 424/93.2 |
| 6,045,802 A | 4/2000 | Schlom et al. | 424/199.1 |
| 6,093,700 A | 7/2000 | Mastrangelo et al. | 514/44 |
| 6,106,826 A | 8/2000 | Brandt et al. | 424/93.2 |
| 6,165,779 A | 12/2000 | Engler et al. | 435/320.1 |
| 6,190,657 B1 | 2/2001 | Pawelek et al. | 424/93.1 |
| 6,235,967 B1 | 5/2001 | Tan et al. | 800/10 |
| 6,235,968 B1 | 5/2001 | Tan et al. | 800/10 |
| 6,251,384 B1 | 6/2001 | Tan et al. | 424/93.21 |
| 6,261,551 B1 | 7/2001 | Wilson et al. | 424/93.2 |
| 6,265,189 B1 | 7/2001 | Paoletti et al. | 435/70.1 |
| 6,428,968 B1 | 8/2002 | Molnar-Kimber et al. | 435/7.23 |
| 6,451,323 B1 | 9/2002 | Garcia-Sastre et al. | 424/214.1 |
| 6,455,673 B1 | 9/2002 | Collier | 530/350 |
| 6,491,905 B1 | 12/2002 | Sorscher et al. | 435/325 |
| 6,503,703 B1 | 1/2003 | Palese et al. | 435/5 |
| 6,511,967 B1 | 1/2003 | Weissleder et al. | 514/44 |
| 6,537,594 B1 | 3/2003 | Paoletti et al. | 424/93.2 |
| 6,548,068 B1 | 4/2003 | Schlom et al. | 424/199.1 |
| 6,562,376 B2 | 5/2003 | Hooper et al. | 424/489 |
| 6,589,531 B1 | 7/2003 | Andino-Pavlovsky et al. | 424/199.1 |
| 6,596,279 B1 | 7/2003 | Paoletti et al. | 424/199.1 |
| 6,649,143 B1 | 11/2003 | Contag et al. | 424/9.1 |
| 6,649,159 B2 | 11/2003 | Yang et al. | 424/93.21 |
| 6,652,849 B2 | 11/2003 | Brown et al. | 424/93.2 |

(Continued)

FOREIGN PATENT DOCUMENTS

AU          709336          4/1995

(Continued)

OTHER PUBLICATIONS

Afanasieva et al. Gene Therapy, 2003, vol. 10, pp. 1850-1859.*
Forastiere et al. J. Clin. Oncology 2001, vol. 19, No. 4, pp. 1088-1095.*
Smith et al. Exp. Opi. Invest. Drugs, 2000, vol. 9, No. 2, pp. 311-327.*
Ober et al. J. Virol. 2002, vol. 76, No. 15, pp. 7713-7723.*
Bubersky Jr. Cancer Cell May 2002, pp. 307-309.*
Schafer et al. Advanced in Enzyme Regulation, 2003, vol. 43, No. 1, pp. 379-391.*
Brown M., "Killer into cure—oncolytic viruses," Microbiol. Today 56:128-131 (2005).
Buller et al., In: Quinnan, G.V. ed. Vaccinia Viruses as Vectors for Vaccine Antigens, New York: Elsevier, pp. 37-46 (1985).
Certified English Translation of Chernos et al., "Tests for safety, 'Take'—Rate, Reactogenicity and Antigenic Properties of a Live Recombinant Smallpox-Hepatitis B Vaccine in Volunteers," Vopr. Virusol. (Moscow) 35:132-135 (1990).
Chang et al. "Targeting vaccinia to solid tumors with local hyperthermia," Hum. Gene Ther. 16:435-444 (2005).

(Continued)

*Primary Examiner* — Bao Li
(74) *Attorney, Agent, or Firm* — McKenna Long & Aldridge LLP; Stephanie Seidman

(57) ABSTRACT

Modified viruses and methods for preparing the modified viruses are provided. Vaccines that contain the viruses are provided. The viruses can be used in methods of treatment of diseases, such as proliferative and inflammatory disorders, including as anti-tumor agents. The viruses also can be used in diagnostic methods.

34 Claims, No Drawings

U.S. PATENT DOCUMENTS

| | | | |
|---|---|---|---|
| 6,685,935 B1 | 2/2004 | Pawelek et al. | 424/93.2 |
| 6,759,038 B2 | 7/2004 | Tan et al. | 424/93.21 |
| 6,884,414 B1 | 4/2005 | Palese et al. | 424/93.2 |
| 6,916,462 B2 | 7/2005 | Contag et al. | 424/9.6 |
| 6,924,128 B2 | 8/2005 | Allen | 435/91.4 |
| 6,974,695 B2 | 12/2005 | Vogels et al. | 435/325 |
| 6,984,374 B2 | 1/2006 | Szalay et al. | 424/9.1 |
| 7,045,313 B1 | 5/2006 | Moss et al. | 435/69.1 |
| 7,112,436 B1 | 9/2006 | Rose-John | 435/325 |
| 7,118,740 B1 | 10/2006 | Russell et al. | 424/93.6 |
| 7,588,767 B2 | 9/2009 | Szalay et al. | 424/199.1 |
| 7,588,771 B2 | 9/2009 | Szalay et al. | 424/232.1 |
| 7,662,398 B2 | 2/2010 | Szalay et al. | 424/232.1 |
| 7,754,221 B2 | 7/2010 | Szalay et al. | 424/199.1 |
| 2001/0029023 A1 | 10/2001 | Szalay et al. | 435/7.1 |
| 2001/0046501 A1 | 11/2001 | Johnson et al. | 424/207.1 |
| 2003/0009015 A1 | 1/2003 | Ulrich et al. | 536/23.1 |
| 2003/0031628 A1 | 2/2003 | Zhao et al. | 424/9.6 |
| 2003/0031681 A1 | 2/2003 | McCart et al. | 424/186.1 |
| 2003/0044384 A1 | 3/2003 | Roberts et al. | 424/93.2 |
| 2003/0059400 A1 | 3/2003 | Szalay | 424/93.2 |
| 2003/0086906 A1 | 5/2003 | Mastrangelo et al. | 424/93.2 |
| 2003/0133949 A1 | 7/2003 | Szalay et al. | 424/200.1 |
| 2003/0165465 A1 | 9/2003 | Roberts et al. | 424/93.2 |
| 2003/0165477 A1 | 9/2003 | Balloul et al. | 424/93.21 |
| 2003/0198627 A1 | 10/2003 | Arts et al. | 424/93.21 |
| 2003/0228261 A1 | 12/2003 | Szalay et al. | 424/9.34 |
| 2003/0228330 A1 | 12/2003 | Falkner et al. | 424/232.1 |
| 2004/0091995 A1 | 5/2004 | Schlom et al. | 435/235.1 |
| 2004/0213741 A1 | 10/2004 | Szalay et al. | 424/9.6 |
| 2004/0214331 A1 | 10/2004 | Frazer et al. | 435/456 |
| 2004/0234455 A1 | 11/2004 | Szalay et al. | 424/9.6 |
| 2005/0025747 A1 | 2/2005 | Laidlaw et al. | 424/93.2 |
| 2005/0031643 A1* | 2/2005 | Szalay et al. | 424/199.1 |
| 2005/0063993 A1 | 3/2005 | Schlom et al. | 424/199.1 |
| 2005/0069491 A1 | 3/2005 | Yu et al. | 424/1.11 |
| 2005/0208074 A1 | 9/2005 | Balloul et al. | 424/232.1 |
| 2005/0249670 A1 | 11/2005 | Szalay et al. | 424/9.32 |
| 2005/0281782 A1 | 12/2005 | Kaufman | 424/93.2 |
| 2006/0051370 A1 | 3/2006 | Szalay et al. | 424/199.1 |
| 2006/0099224 A1 | 5/2006 | Kirn | 424/199.1 |
| 2006/0121509 A1 | 6/2006 | Hermiston et al. | 435/6 |
| 2006/0134801 A1 | 6/2006 | Chada et al. | 436/177 |
| 2006/0153874 A1 | 7/2006 | Howley | 424/232.1 |
| 2006/0159706 A1 | 7/2006 | Panicali | 424/232.1 |
| 2007/0025981 A1 | 2/2007 | Szalay et al. | 424/130.1 |
| 2007/0032419 A1 | 2/2007 | Berdel et al. | 514/12 |
| 2007/0086984 A1 | 4/2007 | Coffey et al. | 424/93.2 |
| 2007/0172455 A1 | 7/2007 | Revel et al. | 424/85.2 |
| 2007/0202572 A1 | 8/2007 | Szalay et al. | 435/69.1 |
| 2007/0212727 A1 | 9/2007 | Szalay et al. | 435/6 |
| 2008/0193373 A1 | 8/2008 | Stritzker et al. | 424/1.17 |
| 2009/0053244 A1 | 2/2009 | Chen et al. | 424/174.1 |
| 2009/0098529 A1 | 4/2009 | Chen et al. | 435/5 |
| 2009/0117047 A1 | 5/2009 | Szalay et al. | 424/9.3 |
| 2009/0117048 A1 | 5/2009 | Szalay et al. | 424/9.3 |
| 2009/0117049 A1 | 5/2009 | Szalay et al. | 424/9.3 |
| 2009/0123382 A1 | 5/2009 | Szalay et al. | 424/9.6 |
| 2009/0136917 A1 | 5/2009 | Szalay et al. | 435/5 |
| 2009/0155287 A1 | 6/2009 | Chen et al. | 424/158.1 |
| 2009/0162288 A1 | 6/2009 | Chen et al. | 424/9.3 |
| 2009/0180987 A1 | 7/2009 | Stritzker et al. | 424/93.2 |
| 2010/0008946 A1 | 1/2010 | Szalay et al. | 424/199.1 |
| 2010/0062016 A1 | 3/2010 | Szalay et al. | 424/199.1 |
| 2010/0196325 A1 | 8/2010 | Szalay et al. | 424/93.6 |
| 2010/0233078 A1 | 9/2010 | Szalay et al. | 424/1.17 |

FOREIGN PATENT DOCUMENTS

| | | |
|---|---|---|
| CA | 2105277 | 12/2006 |
| EP | 0 037 441 | 10/1981 |
| EP | 0 761 687 | 3/1997 |
| EP | 0 861 093 | 5/2000 |
| EP | 1 146 125 | 10/2001 |
| EP | 1 281 772 | 2/2003 |
| EP | 1 489 164 A1 * | 6/2003 |
| EP | 1489164 | 12/2004 |
| EP | 1 512 746 | 3/2005 |
| EP | 1 526 185 | 4/2005 |
| JP | 55-035004 | 3/1980 |
| JP | 09-502993 | 3/1997 |
| WO | WO 92/22327 | 12/1992 |
| WO | WO 95/31105 | 11/1995 |
| WO | WO 96/11279 | 4/1996 |
| WO | WO 96/40238 | 12/1996 |
| WO | WO 97/18841 | 5/1997 |
| WO | WO 97/35997 | 10/1997 |
| WO | WO 99/18799 | 4/1999 |
| WO | WO 99/32646 | 7/1999 |
| WO | WO 00/62735 | 10/2000 |
| WO | WO 00/71718 | 11/2000 |
| WO | WO 00/73479 | 12/2000 |
| WO | WO 01/05229 | 1/2001 |
| WO | WO 01/12234 | 2/2001 |
| WO | WO 01/18195 | 3/2001 |
| WO | WO 01/20989 | 3/2001 |
| WO | WO 03/006069 | 1/2003 |
| WO | WO 03/049117 | 6/2003 |
| WO | WO 03/063593 | 8/2003 |
| WO | WO 03/092600 | 11/2003 |
| WO | WO 2004/014314 | 2/2004 |
| WO | WO 2004/030631 | 4/2004 |
| WO | WO 2004/044175 | 5/2004 |
| WO | WO 2004/098534 | 11/2004 |
| WO | WO 2006/050274 | 5/2006 |
| WO | WO 2007/030668 | 3/2007 |
| WO | WO 2007/075879 | 7/2007 |
| WO | WO 2008/073148 | 6/2008 |
| WO | WO 2008/100292 | 8/2008 |
| WO | WO 2009/054996 | 4/2009 |

OTHER PUBLICATIONS

Chen et al. "Real-time monitoring of vaccinia virus infection in cultured cells and in living mice using light-emitting proteins" *Proceedings of the 14th International Symposium on Bioluminescence & Chemiluminescence: Chemistry, Biology and Applications*, World Scientific: Singapore: 181-184 (2007).

Chernos et al., "Tests for safety, 'Take'—Rate, Reactogenicity and Antigenic Properties of a Live Recombinant Smallpox-Hepatitis B Vaccine in Volunteers", Vopr. Virusol. (Moscow) 35:132-135 (1990).

Coupar et al., "Insertion sites for recombinant vaccinia virus construction: effects on expression of a foreign protein", J. Gen. Virol. 81:431-439 (2000).

DiStefano et al., "Viral-induced remission in chronic lymphocytic leukemia?" Arch. Intern. Med. 139(8):946 (1979).

Enserink M. "Public health. Treating vaccine reactions: two lifelines, but no guarantees", Science 298(5602):2313 (2002).

Etoh et al., "Oncolytic viral therapy for human pancreatic cancer cells by reovirus," Clin. Cancer Res. 9:1218-1223 (2003).

Everts et al., "Replication-selective oncolytic viruses in the treatment of cancer," Cancer Gene Ther. 12:141-161 (2005).

Freeman et al., "Phase I/II trial of intravenous OV001 oncolytic virus in resistant glioblastoma multiforme (GBM)," J. Clin. Oncol. 22(14S):1515 (2004).

Hermiston et al., "Genetically based therapeutics for cancer: similarities and contrasts with traditional drug discovery and development," Mol. Ther. 11(4):496-507 (2005).

Hughes et al., "Vaccinia Virus Encodes an Active Thymidylate Kinase that Complements a cdc8 Mutant of *Saccharomyces cerevisiae*," J. Biol. Chem. 266(30):20103-20109 (1991).

Kambara et al., "Cyclophosphamide allows for in vivo dose reduction of a potent oncolytic virus," Cancer Res. 65(24):11255-11258 (2005).

Kudo-Saito et al., "4-1BB ligand enhances tumor-specific immunity of poxvirus vaccines", Vaccine 24(23):4975-4986 (2006).

Lane et al., "Complications of smallpox vaccination, 1968: results of ten statewide surveys," J. Infect. Dis. 122:303-309 (1970).

Lane et al., "Complications of smallpox vaccinations, 1968: national surveillance in the United States," New Engl. J. Med. 281:1201-1208 (1969).

Lorence et al., "Overview of phase I studies of intravenous administration of PV701, an oncolytic virus", Curr. Opin. Mol. Ther. 5(6):618-624 (2003).

Liu et al., "Systemic Efficacy with Oncolytic Virus Therapeutics: Clinical Proof-of-Concept and Future Directions," Cancer Res. 67:429-432 (2007).

Malhotra et al., "Use of an oncolytic virus secreting GM-CSF as combined oncolytic and immunotherapy for treatment of colorectal and hepatic adenocarcinomas," Surgery 141(4):520-529 (2007).

Moroziewicz et al., "Gene therapy with poxvirus vectors", Curr. Opin. Mol. Ther. 7(4): 317-325 (2005).

Naik et al., "Intravenous and isolated limb perfusion delivery of wild type and a tumor-selective replicating mutant vaccinia virus in non-human primates," Hum Gene Ther. 17:1-15 (2006).

Payne, "Significance of extracellular enveloped virus in the in vitro and in vivo dissemination of vaccinia," J. Gen. Virol. 50(1):89-100 (1980).

Raab et al., "Four-color labeling of cell culture and tumors of live mice upon infection with: GFP-Ruc and RFP-CBG99 expressing Vaccinia virus strains" *Proceedings of the 14th International Symposium on Bioluminescence & Chemiluminescence: Chemistry, Biology and Applications*, World Scientific: Singapore, 197-200 (2007).

Sanz et al., "Identification of a transcription factor, encoded by two vaccinia virus early genes, that regulates the intermediate stage of viral gene expression," Proc. Natl. Acad. Sci., 96(6):2692-2697 (1999).

Sidwell et al., "In vivo antiviral properties of biologically active compounds," Applied Microbiology 16(2):370-392 (1968).

Thorne et al., "Vaccinia virus and oncolytic virotherapy of cancer," Curr Opin Mol Ther. 7(4):359-365 (2005).

Weir et al., "Determination of the Transcriptional Regulatory Region of a Vaccinia Virus Late Gene," J. Virol. 61(1):75-80 (1987).

Yettra, M., "Remission of chronic lymphocytic leukemia after smallpox vaccination," Arch. Intern. Med. 139(5):603 (1979).

Zhan et al., "Tumor-specific intravenous gene delivery using oncolytic adenoviruses" Cancer Gene Ther. 12(1):19-25 (2005).

"A New Way to Kill Cancer: SLU Research Shows Viruses can destroy lung, colon tumors," http://www.sciencedaily.com/releases/2004/05/040517071951.htm (accessed on May 17, 2004) (3 pages).

"WHO Collaborating Centre for Orthopoxvirus Diagnosis and Repository for Variola Virus Strains and DNA," VECTOR: Ministry of Public Health and Social Development of Russian Federation, State Research Center of Virology and Biotechnology http://www.vector.nsc.ru/DesktopDefault.aspx?lcid=9&tabid=294&tabindex=1 (accessed on Nov. 3, 2008) (1 page).

Adonai et al., "Ex vivo cell labeling with 64Cu-pyruvaldehyde-bis(N4-methylthiosemicarbazone) for imaging cell trafficking in mice with positron-emission tomography," Proc. Natl. Acad. Sci. USA 99:3030-3035 (2002).

Advisory Committee on Immunization Practices (ACIP), "Smallpox vaccination and adverse reactions: guidance for clinicians," Morbidity and Mortality Weekly Report 52(RR-4): 1-29 (Feb. 21, 2003).

Advisory Committee on Immunization Practices (ACIP), "Vaccinia (smallpox) vaccine: recommendations of the Advisory Committee on Immunization Practices (ACIP)," MMWR, 50(RR-10): 1-26 & ce1-ce7 (Jun. 22, 2001).

Agha-Mohammadi and Lotze, "Regulatable systems: applications in gene therapy and replicating viruses," J. Clin. Invest. 105(9): 1177-1183 (2000).

Akita et al., "Identification of oligopeptides binding to peritoneal tumors of gastric cancer," Cancer Sci. 97(10):1075-1081 (2006).

Alcamí, A. et al., "Vaccinia virus strains Lister, USSR and Evans express soluble and cell-surface tumour necrosis factor receptors," J. Gen. Virol. 80: 949-959 (1999).

Al'tshtein AD, Zakharova LG, Loparev VN, Pashvykina GV, Gorodetskii SI. [Isolation of a recombinant vaccinia virus based on the LIVP strain inducing the surface antigen of the hepatitis B virus] [Article in Russian]. Dokl Akad Nauk SSSR. 285(3):696-699 (1985).

Altstein et al., "Immunization with influenza A NP-expressing vaccinia virus recombinant protects mice against experimental infection with human and avian influenza viruses," Arch. Virol. 151(5):921-931 (2006).

Amato et al., "Luminous with Promise," Chem. Eng. News. 84(49):69-73 (2006).

Antoine, G. et al., "Characterization of the vaccinia MVA hemagglutinin gene locus and its evaluation as an insertion site for foreign genes", Gene, 177: 43-46 (1996).

Arakawa et al., "Clinical trial of attenuated vaccinia virus AS strain in the treatment of advanced adenocarcinoma. Report on two cases," J Cancer Res Clin Oncol. 113(1):95-98 (1987).

ATCC under Accession No. VR-1549 (accessed on Dec. 10, 2004) (2 pages).

Altschul et al., "Basic local alignment search tool," J. Molec. Biol. 215:403-410 (1990).

Ausubel et al., "Generation of Recombinant Vaccinia Viruses," Unit 16.17 in Short Protocols in Molecular Biology 2nd edition: a compendium of Methods from Current Protocols in Molecular Biology, Green Publishing and Wiley-Interscience Supplement 15:16.71-16.82 (1992).

Baxby, D., "Poxviruses," Chapter 15 in Principles and Practice of Clinical Virology, Zuckerman, A.J. et al.(eds.), John Wiley & Sons Ltd., pp. 451-465 (2000).

Bell et al., "Getting oncolytic virus therapies off the ground," Cancer Cell 4:7-11 (2003).

Bergsland, E. and A. Venook, "Shedding old paradigms: developing viruses to treat cancer," J. Clin. Oncol., 20(9):2220-2222 (2002).

Bernards et al., "Effective tumor immunotherapy directed against an oncogene-encoded produt using a vaccinia virus vector," Proc. Natl. Acad. Sci. USA 84: 6854-6858 (1987).

Beshara et al., "Kinetic analysis of $^{52}$Fe-labelled iron(III) hydroxide-sucrose complex following blous administration using positron emission tomography," Br. J. Haematol. 104: 288-295 (1999).

Beshara et al., "Pharmacokinetics and red cell utilization of iron(III) hydroxide-sucrose complex in anaemic patients: a study using positron emission tomography," Br. J. Haematol. 104: 296-302 (1999).

Bevis and Glick, "Rapidly maturing variants of the Discosoma red fluorescent protein (DsRed)," Nat. Biotechnol., 20: 83-87 (2002).

Blanchard, T.J. et al., "Modified vaccinia virus Ankara undergoes limited replication in human cells and lacks several immunomodulatory proteins: implications for use as a human vaccine," Journal of General Virology, 79: 1159-1167 (1998).

Blasco et al., "Dissociation of progeny vaccinia virus from the cell membrane is regulated by a viral envelope glycoprotein: effect of a point mutation in the lectin homology domain of the A34R gene," J Virol. 67(6):3319-3325 (1993).

Blasco, R. and B. Moss, "Role of cell-associated enveloped vaccinia virus in cell-to-cell spread," J Virol., 66(7):4170-4179 (1992).

Blasco, R. and B. Moss, "Selection of recombinant vaccinia viruses on the basis of plaque formation," Gene, 158: 157-162 (1995).

Blumenreich et al., "High-dose cisplatin in patients with advanced malignancies," Cancer 55(5): 1118-1122 (1985).

Bouvier et al., "Functional characterization of the human dopamine D-4.2 receptor using vaccinia virus as an expression system," European Journal of Pharmacology 290(1):11-17 (1995).

Breman, J. and D. Henderson, "Diagnosis and management of smallpox," N. Engl. J. Med. 346(17):1300-1308 (2002).

Broder, C. and P. Earl, "Recombinant Vaccinia Viruses," Mol. Biotechnol. 13:223-245 (1999).

Broder et al., "Expression of foreign genes in cultured human primary macrophages using recombinant vaccinia virus vectors," Gene, 142: 167-174 (1994).

Broyles, S. and M. Kremer, "An in vitro transcription system for studying vaccinia virus early genes," Methods Mol Biol.;269:135-142 (2004).

Broyles, S., "Vaccinia virus transcription," J Gen Virol., 84(Pt 9):2293-2303 (2003).

Broyles et al., "Transcription factor YY1 is a vaccinia virus late promoter activator," J Biol Chem., 274(50):35662-35667 (1999).

Buller et al., "Decreased virulence of recombinant vaccinia virus expression vectors is associated with a thymidine kinase-negative phenotype," Nature 317:813-815 (1985).

Burton et al., "Multiple Applications for Replication-Defective Herpes Simplex virus vectors," Stem Cells 19:358-377 (2001).

Calonder et al., "Kinetic modeling of $^{52}$Fe/$^{52m}$Mn-Citrate at the Blood-Brain Barrier by Positron Emission Tomography," J. Neurochem. 73: 2047-2055 (1999).

Carrillo and Lipman et al., "The Multiple Sequence Alignment Problem in Biology," SIAM J Applied Math 48:1073-1082 (1988).
Carter et al., "Vaccinia virus cores are transported on microtubules," Journal of General Virology, 84: 2443-2458 (2003).
Certified English translation of journal article for Al'tshtein [Altshteyn] et al., "[Isolation of a recombinant vaccinia virus based on the LIVP strain inducing the surface antigen of the hepatitis B virus]," Dokl Akad Nauk SSSR. 285(3):696-699 (1985) [Article in Russian].
Certified English translation of Timiryasova et al., "Analysis of Reporter Gene Expression in Various Regions of the Genome of the Vaccinia Virus," Molecular Biology 27(2): 2-11 (1993) [Article in Russian].
Chakrabarti et al., "Compact, synthetic, vaccinia virus early/late promoter for protein expression," Biotechniques., 23(6):1094-1097 (1997).
Chakrabarti et al., "Vaccinia virus expression vector: coexpression of β-galactosidase provides visual screening of recombinant virus plaques," Mol. Cell Biol. 5:3403-3409 (1985).
Chalikonda et al., "Oncolytic virotherapy for ovarian carcinomatosis using a replication-selective vaccinia virus armed with a yeast cytosine deaminase gene," Cancer Gene Ther. 15(2):115-125 (2008).
Chaloupka et al.,"Comparative Analysis of Six European Influenza Vaccines," European J. Microbiology Infectious Disease 15(2):121-127 (1996).
Chamberlain et al., "Costimulation enhances the active immunotherapy effect of recombinant anticancer vaccines," Cancer Res. 56: 2832-2836 (1996).
Chavan et al. "Expression of CCL20 and granulocyte-macrophage colony-stimulating factor, but not Flt3-L, from modified vaccinia virus ankara enhances antiviral cellular and humoral immune responses," J. Virol. 80(15):7676-7687 (2006).
Cheadle, E.J. and A.M. Jackson, "Bugs as Drugs for Cancer," Immunol., 107: 10-19 (2002).
Chen et al. "Evaluation of combined vaccinia virus-mediated antitumor gene therapy with p53, IL-2, and IL-12 in a glioma model," Cancer Gene Ther. 7(11):1437-1447 (2000).
Chen et al., "Evaluation of Cytokine Toxicity Induced by Vaccinia Virus-mediated IL-2 and IL-2 Antitumor Immunotherapy," Cytokine 15(61):305-314 (2001).
Chen et al., "Low-dose vaccinia virus-mediated cytokine gene therapy of glioma," J Immunother. 24(1):46-57 (2001).
Chernajovsky et al., "Fighting cancer with oncolytic viruses," BMJ 332(7534):170-172 (2006).
Chkheidze et al., "Identification of DNA binding proteins in vaccinia virus by DNA-protein crosslinking," FEBS 336(2):340-342 (1993).
Child et al., "Insertional inactivation of the large subunit of ribonucleotide reductase encoded by vaccinia virus is associated with reduced virulence in vivo," Virology 174:625-629 (1990).
Chiocca, E., "Oncolytic Viruses," Nat. Rev. Cancer, 2(12): 938-950 (2002).
Chung et al., "Vaccinia virus proteome: identification of proteins in vaccinia virus intracellular mature virion particles," J Virol., 80(5):2127-2140 (2006).
Colinas et al., "A DNA ligase gene in the copenhagen strain of vaccinia virus is nonessential for viral replication and recombination," Virology 179: 267-275 (1990).
Conry et al., "Phase I trial of a recombinant vaccinia virus encoding carcinoembryonic antigen in metastatic adenocarcinoma: comparison of intradermal versus subcutaneous administration," Clin Cancer Res, 5:2330-2337. (1999).
Contag et al., "Photonic detection of bacterial pathogens in living hosts," Mol. Microbiol. 18: 593-603 (1995).
Contag et al., "Visualizing Gene Expression in Living Mammals Using a Bioluminescent Reporter," Photochemistry and Photobiology 66(4):523-531 (1997).
Coupar et al., "A general method for the construction of recombinant vaccinia viruses expressing multiple foreign genes," Gene, 68: 1-10 (1988).
Crystal, R., "Transfer of Genes to Humans: Early Lessons and Obstacles to Success," Science 270:404-410 (1995).

Daly et al., "Monocyte Chemoattractant Protein-1 (CCL2) in Inflammatory Disease and Adaptive Immunity: Therapeutic Opportunities and Controversies," Microcirculation 10:247-257 (2003).
Davidson et al, "Kringle 5 of human plasminogen induces apoptosis of endothelial and tumor cells through surface-expressed glucose-regulated protein 78," Cancer Res. 65: 4663-4672 (2005).
Davis et al., "Oncolytic virotherapy for cancer treatment: challenges and solutions," J. Gene Med. 7(11):1380-1389 (2005).
Davison, A. and B. Moss, "New vaccinia virus recombination plasmids incorporating a synthetic late promoter for high level expression of foreign proteins," Nucleic Acids Res., 18(14):4285-4286 (1990).
Davison, A. and B. Moss, "Structure of vaccinia virus early promoters," J Mol Biol., 210(4):749-769 (1989).
Davison, A. and B. Moss, "Structure of vaccinia virus late promoters," J Mol Biol., 210(4):771-784 (1989).
de Wet et al., "Firefly Luciferase Gene: Structure and Expression in Mammalian Cells," Mol. Cell. Biol. 7: 725-737 (1987).
Delhon et al., "Genomes of the parapoxviruses ORF virus and bovine papular stomatitis virus," J Virol., 78(1):168-177 (2004).
Dellis et al.,"Protein interactions among the vaccinia virus late transcription factors," Virology., 24;329(2):328-336 (2004).
Demkowicz et al., "Human Cytotoxic T-Cell Memory: Long-Lived Responses to Vaccinia Virus" J. Virol. 70(4):2627-2631 (1996).
Derwent English abstract for Japanese Patent Publication JP 55035004, published Feb. 3, 1987, entitled, "Cellular immuno-potentiator—contg. Vaccinia attenuated virus showing no infectivity to man or rabbit and has lost humoral immunity," Derwent Accession No. 2512008.
Devereux, J., et al., "A comprehensive set of sequence analysis programs for the VAX," Nucleic Acids Research 12(1): 387-95 (1984).
de Wet et al. "Firefly Luciferase Gene: Structure and Expression in Mammalian Cells," Mol. Cell. Biol. 7: 725-737 (1987).
Dobbelstein, M., "Viruses in therapy—royal road or dead end?," Virus Research, 92: 219-221 (2003).
Domi, A. and B. Moss, "Cloning the vaccinia virus genome as a bacterial artificial chromosome in *Escherichia coli* and recovery of infectious virus in mammalian cells," Proc. Natl. Acad. Sci. U.S.A., 99(19): 12415-12420 (2002).
Drexler et al., "Modified vaccinia virus Ankara as antigen delivery system: how can we best use its potential," Curr. Opin. Biotechnol. 15(6):506-512 (2004).
Dunn et al., "Cancer immunoediting: from immunosurveillance to tumor escape," Nat Immunol. 3(11):991-998 (2002).
Earl et al., "T-Lymphocyte Priming and Protection Against Friend Leukemoa by Vaccinia-Retrovirus env Gene Recombinant," Science 234: 728-731 (1986).
Eastham et al. "Prostate cancer gene therapy: herpes simplex virus thymidine kinase gene transduction followed by ganciclovir in mouse and human prostate cancer models," Hum Gene Ther. 7(4):515-523 (1996).
Eck et al., "Gene-Based Therapy" Goodman & Gilman's The Pharmacological Basis of Therapeutics, McGraw-Hill, New York, 77-101 (1996).
Edmonson et al., "Evolution of a simian immunodeficiency virus pathogen," J. Virol. 72(1):405-414 (1998).
Eisenberger et al., "Viral vaccines for cancer immunotherapy," Hematol Oncol Clin North Am. 20(3):661-687 (2006).
Escher, A. et al., "Bacterial luciferase αβ fusion protein is fully active as a monomer and highly sensitive in vivo to elevated temperature," Proc Natl Acad Sci U S A. 86(17):6528-6532 (1989).
Esposito, J.J. and F. Fenner, "Poxviruses," Chapter 85 in Field's Virology, 4th Edn., vol. 2, 2885-2921. Edited by D. M. Knipe and P. M. Howley, Philadelphia: Lippincott Williams & Wilkins, (2001).
Estin et al, "Recombinant vaccinia virus vaccine against the human melanoma antigen p97 for use in immunotherapy," Proc. Natl. Acad. Sci. USA 85: 1052-1056 (1988).
Falkner and Moss, "Transient dominant selection of recombinant vaccinia viruses," J. Virol. 64:3108-3111 (1990).
Fatyol, K and A.A. Szalay, "The p14$^{ARF}$ tumor suppressor protein facilitates nucleolar sequestration of hypoxia-inducible factor-1I (HIF-1I ) and inhibits HIF-1-mediated transcription," J Biol Chem. 276(30):28421-28429 (2001).

Fisher, "Is mda-7/IL-24 a 'Magic Bullet' for Cancer?," Cancer Res. 65(22):10128-10138 (2005).
Flexner et al., "Characterization of Human Immunodeficiency Virus gag/pol Gene Products Expressed by Recombinant Vaccinia Viruses," Virology 166: 339-349 (1988).
Fodor et al., "Vaccinia virus mediated p53 gene therapy for bladder cancer in an orthotopic murine model," J. Urol. 173(2):604-609 (2005).
Fogg et al., "Protective immunity to vaccinia virus induced by vaccination with multiple recombinant outer membrane proteins of intracellular and extracellular virions," J Virol., 78(19):10230-10237 (2004).
Foran, D. and W. Brown, "Nucleotide sequence of the LuxA and LuxB genes of the bioluminescent marine bacterium *Vibrio fischeri*," Nucleic Acids Res. 16: 777 (1988).
Forastiere et al., "Phase III comparison of high-dose paclitaxel + cisplatin + granulocyte colony-stimulating factor versus low-dose paclitaxel + cisplatin in advanced head and neck cancer: Eastern Cooperative Oncology Group Study E1393," J. Clin. Oncol. 19(4): 1088-1095 (2001).
Gallagher, R., "Vaccination Undermined," The Scientist, 17(22): 1-3 (2003).
Galmiche et al., "Neutralizing and protective antibodies directed against vaccinia virus envelope antigens," Virology, 254(1):71-80 (1999).
Gautam et al., "Delivery systems for pulmonary gene therapy," American Journal of Respiratory Medicine, 1(1):35-46 (2002).
Gherardi et al., "Recombinant poxviruses as mucosal vaccine vectors," J Gen Virol 86:2925-2936 (2005).
Giavedoni et al., "Vaccinia virus recombinants expressing chimeric proteins of human immunodeficiency virus and gamma-interferon are attenuated for nude mice," Proc. Natl. Acad. Sci. 89:3409-3413 (1992).
Gnant et al., "Regional versus systemic delivery of recombinant vaccinia virus as suicide gene therapy for murine liver metastases," Ann Surg., 230(3):352-360 (1999).
Gnant et al., "Sensitization of tumor necrosis factor α-resistant human melanoma by tumor-specific in vivo transfer of the gene encoding endothelial monocyte-activating polypeptide II using recombinant vaccinia virus," Cancer Research 59:4668-4674 (1999).
Gnant et al., "Systemic administration of a recombinant vaccinia virus expressing the cytosine deaminase gene and subsequent treatment with 5-fluorocytosine leads to tumor-specific gene expression and prolongation of survival in mice," Cancer Res. 59(14):3396-3403 (1999).
Gnant, M.F.X. et al, "Tumor-Specific Gene Delivery Using Recombinant Vaccinia Virus in a Rabbit Model of Liver Metastases," Journal of the National Cancer Institute, 91(20):1744-1750 (1999).
Goebel et al., "Appendix to 'The complete DNA Sequence of Vaccinia Virus,'" Virology 179: 517-563 (1990).
Goebel et al., "The complete DNA sequence of vaccinia virus," Virology 179:247-266 (1990).
Gomella et al., "Phase I Study of Intravesical Vaccinia Virus as a Vector for Gene Therapy of Bladder Cancer," J. Urology, 166:1291-1295 (2001).
Gómez, C. and M. Esteban, "Recombinant proteins produced by vaccinia virus vectors can be incorporated within the virion (IMV form) into different compartments," Arch. Virol., 146: 875-892 (2001).
Gorecki, D., "Prospects and problems of gene therapy: an update," Expert Opin. Emerging Drugs 6(2):187-198 (2001).
Gribskov et al., "Sigma factors from *E. coli, B. subtilis*, phage SP01, and phage T4 are homologous proteins," Nucl. Acids Res. 14:6745-6763 (1986).
Gridley et al., "Evaluation of radiation effects against C6 glioma in combination with vaccinia virus-p53 gene therapy," Int J Oncol. 13(5):1093-1098 (1998).
Grove et al. "Virus-directed enzyme prodrug therapy using CB1954," Anti-Cancer Drug Design 14(6) 461-472 (1999).
Guo et al., "The enhanced tumor selectivity of an oncolytic vaccinia lacking the host range and antiapoptosis genes SPI-1 and SPI-2," Cancer Res. 65(21):9991-9998 (2005).

Guo et al., "Vaccinia as a vector for gene delivery," Expert Opin Biol Ther 4(6):901-917 (2004).
Gura, T., "Systems for identifying new drugs are often faulty," Science, 278:1041-1042, (1997).
Haga et al., "Evasion of innate immunity by vaccinia virus," Parasitology 130:S11-S25 (2005).
Halsell et al., "Myopericarditis Following Smallpox Vaccination Among Vaccinia-Naïve US Military Personnel," J. Am. Med. Assoc., 289(24): 3283-3289 (2003).
Hammond et al., "A synthetic vaccinia virus promoter with enhanced early and late activity," J Virol Methods, 66(1):135-138 (1997).
Hansen, R. and J. Libnoch, "Remission of Chronic Lymphocytic Leukemia After Smallpox Vaccination," Arch. Intern. Med., 138: 1137-1138 (1978).
Hasegawa et al., "In vivo tumor delivery of the green fluorescent protein gene to report future occurrence of metastasis," Cancer Gene Therapy 7: 1336-1340 (2000).
Hauser et al., "Poxvirus as a vector to transduce human dendritic cells for immunotherapy: abortive infection but reduced APC function," Gene Ther. 7(18):1575-1583 (2000).
Hawkins et al., "Oncolytic biotherapy: a novel therapeutic platform," The Lancet Oncology, 3: 17-26 (2002).
Heise et al., "Efficacy of a replication-competent adenovirus (ONYX-015) following intratumoral injection: intratumoral spread and distribution effects," Cancer Gene Ther., 6(6):499-504 (1999).
Hermiston, T.W. and I. Kuhn, "Armed therapeutic viruses: Strategies and challenges to arming oncolytic viruses with therapeutic genes," Cancer Gene Therapy, 9: 1022-1035 (2002).
Hershey et al., "Adjuvant Immunotherapy of Patients With High-Risk Melanoma Using Vaccinia Viral Lysates of Melanoma: Results of a Randomized Trial," Journal of Clinical Oncology, 20(20): 4181-4190 (2002).
Hiller et al., "Characterization of Intracellular and Extracellular Vaccinia Virus Variants: $N_1$-Isonicotinoyl-$N_2$-3-Methyl-4-Chlorobenzoylhydrazine Interferes with Cytoplasmic Virus Dissemination and Release," Journal of Virology 39(3): 903-913 (1981).
Hodge et al., "Induction of antitumor immunity by recombinant vaccinia viruses expressing B7-1 or B7-2 costimulatory molecules," Cancer Res. 54(21):5552-5555 (1994).
Hogaboam et al., "Therapeutic use of Chemokines," Current. Pharm. Design6:651-663 (2000).
Hogervorst et al., "Modulation of Experimental Autoimmunity: Treatment of Adjuvant Arthritis by Immunization with a Recombinant Vaccinia Virus," Infection Immunity 59(6):2029-2035 (1991).
Hollinshead et al., "Vaccinia virus utilizes microtubules for movement to the cell surface," J Cell Biol., 154(2):389-402 (2001).
Horton et al., "Gene splicing by overlap extension," Methods Enzymol., 217:270-279 (1993).
Hube et al., "The promoter competition assay (PCA): a new approach to identify motifs involved in the transcriptional activity of reporter genes," Front Biosci., 11:1577-1584 (2006).
Huebner et al. "Production of type-specific antigen in virus-free hamster tumor cells induced by adenovirus type 12," Proc. Natl. Acad. Sci. 51:432-439 (1964).
Humlova et al., "Vaccinia virus induces apoptosis of infected macrophages," J. General Virol., 83: 2821-2832 (2002).
Ikeda et al., "Oncolytic virus therapy of multiple tumors in the brain requires suppression of innate and elicited antiviral responses," Nat Med., 5(8):881-887 (1999).
Isaacs et al., "Vaccinia virus complement-control protein prevents antibody-dependent complement-enhanced neutralization of infectivity and contributes to virulence," Proc Natl Acad Sci U S A. 89:628-632 (1992).
Jia et al., "Viral vectors for cancer gene therapy: Viral dissemination and tumor targeting," Curr. Gene Ther. 5:133-142 (2005).
Johnson et al., "An update on the vaccinia virus genome," Virology 196: 381-401 (1993).
Joklik, W., "The Purification of Four Strains of Poxviruses," Virology 18:9-18 (1962).
Kagaya et al., "Monocyte chemoattractant protein-1 gene delivery enhances antitumor effects of herpes simplex virus thymidine kinase/ganciclovir system in a model of colon cancer," Cancer Gene Therapy 13:357-366 (2006).

Kantor et al., "Antitumor Activity and Immune Responses Induced by a Recombinant Carcinoembryonic Antigen-Vaccinia Virus Vaccine," J. Natl. Cancer Inst. 84: 1084-1091 (1992).

Kaplitt et al.,, "Mutant herpes simplex virus induced regression of tumors growing in immunocompetent rats," J. Neurooncol 19(2): 137-147 (1994).

Kass et al., "Comparative studies of the effects of recombinant GM-CSF and GM-CSF administered via a poxvirus to enhance the concentration of antigen-presenting cells in regional lymph nodes" Cytokine 12(7):960-971 (2000).

Kass et al, "Induction of Protective Host Immunity to Carcinoembryonic Antigen (CEA), a Self-Antigen in CEA Transgenic Mice, by Immunizing with a Recombinant Vaccinia-CEA Virus," Cancer Research 59:676-683 (1999).

Kato et al., "An alternative genetic method to test essential vaccinia virus early genes," J Virol Methods., 115(1):31-40 (2004).

Katz et al., "Mutations in the vaccinia virus A33R and B5R envelope proteins that enhance release of extracellular virions and eliminate formation of actin-containing microvilli without preventing tyrosine phosphorylation of the A36R protein," J. Virology 77:12266-12275 (2003).

Kaufman et al., "A phase I trial of intra lesional RV-B7.1 vaccine in the treatment of malignant melanoma" Hum. Gene Ther. 11(7):1065-82 (2000).

Kaufman et al., "A recombinant vaccinia virus expressing human carcinoembryonic antigen CEA", Int. J. Cancer 48(6):900-907 (1991).

Kaufman et al., "Insertion of interleukin-2 (IL-2) and interleukin-12 (IL-12) genes into vaccinia virus results in effective anti-tumor responses without toxicity," Vaccine 20:1862-1869 (2002).

Kaufman, H., et al., "A recombinant vaccinia virus expressing human carcinoembryonic antigen CEA," International Journal of Cancer, 48(6):900-907, (1991).

Kaufman HL, Wang W, Manola J, DiPaola RS, Ko YJ, Sweeney C, et al. Phase II randomized study of vaccine treatment of advanced prostate cancer (E7897):a trial of the Eastern Cooperative Oncology Group. J Clin Oncol 2004;22:2122-32.

Kaufman et al., "Targeting the local tumor microenvironment with vaccinia virus expressing B7.1 for the treatment of melanoma," J. Clin. Investigation 115(7):1903-1912 (2005).

Kawa, A. and S. Arakawa, "The Effect of Attenuated Vaccinia Virus AS Strain on Multiple Myeloma; A Case Report", Japan. J. Exp. Med. 58(1): 79-81 (1987).

Kaye et al., "A single amino acid substitution results in a retinoblastoma protein defective in phosphorylation and oncoprotein binding," Proc. Natl. Acad. Sci. USA 87:6922-6926 (1990).

Kay et al., "Transient immunomodulation with anti-CD40 ligand antibody and CTLA4Ig enhances persistence and secondary adenovirus-mediated gene transfer into mouse liver," Proc Natl Acad Sci U S A. 94(9):4686-4691 (1997).

Kelland et al. "Of mice and men: values and liabilities of the athymic nude mouse model in anticancer drug development," European J. Cancer 40:827-836 (2004).

Kerbel et al., "Human Tumor Xenografts as Predictive Preclinical Models for Anticancer Drug Activity in Humans" Cancer Biology & Therapy 2:4 suppl. 1, S134-S139 (2003).

Khalil et al., "Mechanism of action of tubulysin, an antimitotic peptide from myxobacteria," Chembiochem. 7(4):678-683 (2006).

Kim et al. "A tale of two trials: selectively replicating herpesviruses for brain tumors" Gene Therapy 7(10):815-816 (2000).

Kim et al., "Overview analysis of adjuvant therapies for melanomaFa special reference to results from vaccinia melanoma oncolysate adjuvant therapy trials," Surgical Oncology, 10: 53-59 (2001).

Kim et al., "Systemic armed oncolytic and immunologic therapy for cancer with JX-594, a targeted poxvirus expressing GM-CSF," Mol. Ther. 14(3):361-370 (2006).

Kirn, D. and F. McCormick, "Replicating viruses as selective cancer therapeutics," Mol Med Today 2(12): 519-527 (1996).

Knutson et al., "Vaccinia virus intermediate and late promoter elements are targeted by the TATA-binding protein," J Virol. (14):6784-6793 (2006).

Kotwal et al., "Mapping and Insertional Mutagenesis of a Vaccinia Virus Gene Encoding a 13, 800-Da Secreted Protein," Virology 171:579-587 (1989).

Krauss et al., "An investigation of incorporation of cellular antigens into vaccinia virus particles," J Gen Virol. 83(Pt 10):2347-2359 (2002).

Kutinova et al., "Hepatitis B virus proteins expressed by recombinant vaccinia viruses: influence of preS2 sequence on expression surface and nucleocapsid proteins in human diploid cells," Archives of Virology 134:1-15 (1994).

Kutinova et al., "Search for optimal parent for recombinant vaccinia virus vaccines. Study of three vaccinia virus vaccinal strains and several virus lines derived from them," Vaccine 13(5): 487-493 (1995).

Kwak et al., "Poxviruses as vectors for cancer immunotherapy," Curr. Opin. Drug Disc. Develop., 6(2):161-168 (2003).

Larson et al., "Triumph over mischance: a role for nuclear medicine in gene therapy," J Nucl Med. 38(8):1230-1233 (1997).

Lathe et al., "Tumour prevention and rejection with recombinant vaccinia," Nature (London) 326: 878-880 (1987).

Lattime et al., "In Situ Cytokine Gene Transfection Using Vaccinia Virus Vectors," Semin Oncol 23(1): 88-100 (1996).

Law, M. and G. Smith, "Antibody neutralization of the extracellular enveloped form of vaccinia virus," Virology. Feb. 1, 2001;280(1):132-142 (2001).

Lee et al., "Molecular attenuation of vaccinia virus: mutant generation and animal characterization," Journal of Virology 66:2617-2630 (1992).

Leenders et al., "Blood to brain iron uptake in one Rhesus monkey using [Fe-52]-citrate and positron emission tomography (PET): influence of haloperidol," J. Neural.Transm.Suppl. 43:123-132 (1994).

Lewis et al., "Comparison of Four $^{64}$Cu-Labeled Somatostatin Analogues in Vitro and in a Tumor-Bearing Rat Model: Evaluation of New Derivatives for Positron Emission Tomography Imaging and Targeted Radiotherapy," J. Med. Chem. 42: 1341-1347 (1999).

Liu et al., "Clinical trial results with oncolytic virotherapy: a century of promise, a decade of progress," Nat Clin Pract Oncol 4:101-116 (2006).

Liu et al., "Expression of human granulocyte-macrophage colony stimulating factor (hGM-CSF) by recombinant vaccinia virus and its effect on immunogenicity," Zhonghua Shi Yan He Lin Chuang Bing Za Zhi 12(1):47-50 (1998).

Lopez-Guerrero et al., "Therapeutic effect of recombinant vaccinia virus expressing the 60-kd heat shock protein on adjuvant arthritis," Arthr Rheum 37(10):1462-1467 (1994).

Lorenz et al., "Isolation and expression of a cDNA encoding *Renilla reniformis* luciferase," PNAS USA 88:4438-4442 (1991).

Lorenzo et al., "Intracellular localization of vaccinia virus extracellular enveloped virus envelope proteins individually expressed using a Semliki Forest virus replicon," J Virol. 74(22):10535-10550 (2000).

Lu et al., "Delivery of adenoviral vectors to the prostate for gene therapy," Cancer Gene Therapy 6(1):64-72 (1999).

Lukashev et al., "Late expression of nitroreductase in an oncolytic adenovirus sensitizes colon cancer cells to the prodrug CB1954," Hum. Gene Ther. 16(12):1473-1483 (2005).

Martinez et al., "Specific antibody to *Cryptococcus neoformans* glucurunoxylomannan antagonizes antifungal drug action against cryptococcal biofilms in vitro" J. Infect. Diseases 194:261-266 (2006).

Massoud et al., "Molecular imaging in living subjects: seeing fundamental biological processes in a new light", Genes & Develop. 17:545-580 (2003).

Mastrangelo et al., "Intratumoral recombinant GM-CSF-encoding virus as gene therapy in patients with cutaneous melanoma," Cancer Gene Ther. 6(5):409-422 (1998).

Mastrangelo et al., "Poxvirus vectors: orphaned and underappreciated," J. Clin. Invest., 105(8): 1031-1034 (2000).

Mastrangelo et al., "Virotherapy clinical trials for regional disease: In situ immune modulation using recombinant poxvirus vectors," Cancer Gene Therapy 9:1013-1021 (2002).

Matz et al., "Fluorescent proteins from nonbioluminescent Anthozoa species," Nat.Biotech. 17: 969-973 (1999).

Mayford et al., "CaMKII regulates the frequency-response function of hippocampal synapses for the production of both LTD and LTP," Cell 81:891-904 (1995).

Mayr et al., "The smallpox vaccination strain MVA: marker, genetic structure, experience gained with the parenteral vaccination and behavior in organisms with a debilitated defense mechanism," Zentbl. Bakteriol. Hyg. Abt 1 Orig. B 167:375-390 (1978).

McAneny et al., "Results of a Phase I trial of a recombinant vaccinia virus that expresses carcinoembryonic antigen in patients with advanced colorectal cancer,"Ann. Surg. Oncol. 3(5):495-500 (1996).

McCart et al., "Oncolytic vaccinia virus expressing the human somatostatin receptor SSTR2: molecular imaging after systemic delivery using 111In-Pentetreotide," Mol. Ther. 10(3): 553-561 (2004).

McCart et al., "Complex interactions between the replicating oncolytic effect and the enzyme/prodrug effect of vaccinia-mediated tumor regression," Gene Ther. Jul. 2000;7(14):1217-1223 (2000).

McCart et al., "Systemic Cancer Therapy with a Tumor-selective Vaccinia Virus Mutant Lacking Thymidine Kinase and Vaccinia Growth Factor Genes," Cancer Research 61:8751-8757 (2001).

McCluskie et al., "Route and method of delivery of DNA vaccine influence immune responses in mice and non-human primates," Mol. Med. 5:287-300 (1999).

McFadden, G., "Poxvirus tropism," Nat. Rev. Microbiol. 3(3):201-213 (2005).

McIntosh, A. and G. Smith, "Vaccinia virus glycoprotein A34R is required for infectivity of extracellular enveloped virus," J Virol. Jan. 1996;70(1):272-81.

Meiser et al., "Comparison of virus production in chicken embryo fibroblasts infected with the WR, IHD-J and MVA strains of vaccinia virus: IHD-J is most efficient in trans-Golgi network wrapping and extracellular enveloped virus release," J Gen Virol. 84(Pt 6):1383-1392 (2003).

Meyer et al., "Mapping of deletions in the genome of the highly attenuated vaccinia virus MVA and their influence on virulence," Journal of General Virology 72(Pt 5): 1031-1038 (1991).

Mikryukov et al., "Structural-functional organization of segment of vaccinia virus genome," Soviet Biotechnology (Biotekhnologiya) 4: 19-25 (1988).

Miller et al., "The efficacy of electroporated plasmid vaccines correlate long-term antigen production in vivo," Vaccine 22:2517-2523 (2004).

Moore et al., "Steroid hormone synthesis by a vaccinia enzyme: a new type of virus virulence factor," EMBO J. 1992 11:1973-1980, corrigendum in The EMBO Journal 11(9):3490 (1992).

Moore, A., "Effects of Viruses on Tumors", Arum. Rev. Microbiol., 8: 393-402 (1954).

Moss, B., "Genetically engineered poxviruses for recombinant gene expression, vaccination, and safety," Proc. Natl. Acad. Sci. USA 93: 11341-11348 (1996).

Moss, B., "Poxvirus vectors: cytoplasmic expression of transferred genes," Curr. Opin. Genet. Dev. 3: 86-90 (1993).

Mukherjee et al., "Replication-restricted vaccinia as a cytokine gene therapy vector in cancer: persistent transgene expression despite antibody generation," Cancer Gene Ther. 7(5):663-70 (2000).

Mullen et al., "Viral Oncolysis," The Oncologist 7:106-119 (2002).

Mulryan et al., "Attenuated recombinant vaccinia virus expressing oncofetal antigen (tumor-associated antigen) 5T4 induces active therapy of established tumors," Mol Cancer Ther 1(12): 1129-1137 (2002).

Muravlev et al., "Protective activity of vaccinia virus envelope proteins isolated with the use of nonionic detergents," Voprosy Virusologii 40(4): 154-8 (1995).

Murphy et al., "An update on approaches to the development of respiratory syncytial virus (RSV) and parainfluenza virus type 3 (PIV3) vaccines," Virus Res. 1994, 32:13-26.

Mutschler et al., "10. Chemotherapy of Malignant Tumors" in: Drug Actions: Basic Principles and Therapeutic Aspects (medpharm (CRC Press), Suttgart, pp. 595-612 (1995).

Nagai et al., "A variant of yellow fluorescent protein with fast and efficient maturation for cell-biological applications," Nat. Biotechnol. 20(1):87-90 (2002).

Nagase et al., "Effects of intralesional versus ip administration of cisplatin on squamous cell carcinoma of mice," Cancer Treat. Rep. 71(9):825-829 (1987).

NCBI Nucleotide AF095689 (accessed on Oct. 23, 2008) (119 pages).

NCBI Nucleotide AY009089 (accessed on Oct. 23, 2008) (153 pages).

NCBI Nucleotide AY243312 (accessed on Oct. 23, 2008) (138 pages).

NCBI Nucleotide AY603355 (accessed on Oct. 23, 2008) (123 pages).

NCBI Nucleotide M35027 (accessed on Oct. 23, 2008) (123 pages).

NCBI Nucleotide M57977 (accessed on Oct. 23, 2008) (11 pages).

NCBI Nucleotide U94848 (accessed on Oct. 23, 2008) (114 pages).

NCBI Nucleotide X69198 (accessed on Oct. 23, 2008) (125 pages).

NCBI Nucleotide X94355 (accessed on Oct. 23, 2008) (145 pages).

NCBI Protein AAA48282 (accessed on Oct. 23, 2008) (2 pages).

Needleman et al., "A general method applicable to the search for similarities in the amino acid sequences of two proteins," J. Mol. Biol. 48:443-453 (1970).

Netesova et al., "Structural and functional studies of the HindIII-I-Genome Fragment of Vaccinia virus Strain L-IVP," Mol Biol (Mosk.) Nov.-Dec.; 25(6): 1526-32 (1991).

Neyts et al., "Therapy and short-term prophylaxis of poxvirus infections: historical background and perspectives", Antivir. Res. 57: 25-33 (2003).

Nguyen, A. and P. Daugherty, "Evolutionary optimization of fluorescent proteins for intracellular FRET," Nat Biotechnol. 23(3):355-360 (2005).

Norton et al., "Expression of Secreted Platelet-Derived Growth Factor-B by Recombinant Nonreplicating and Noncytopathic Vaccinia Virus," Annals of Surgery 224(4):555-562 (1996).

Novellino et al., "A listing of human tumor antigens recognized by T cells:Mar. 2004 update," Cancer Immunol Immunother. 54(3):187-207 (2005).

Ober et al., "Immunogenicity and safety of defective vaccinia virus lister:comparison with modified vaccinia virus ankara", J. Virol. 76(15):7713-7723 (2002).

Oertli et al., "Non-replicating recombinant vaccinia virus encoding murine B-7 molecules effective costimulation of naive $CD4^+$ splenocytes in vitro," J. Gen. Virol. 77: 3121-3125 (1996).

Oh, J. and S. Broyles, "Host cell nuclear proteins are recruited to cytoplasmic vaccinia virus replication complexes," J Virol. 79(20):12852-12860 (2005).

Okada et al., "Sensitization of human tumor cells to homologous complement by vaccinia virus treatment," Cancer Immunol Immunother 25(1):7-9 (1987).

Okuse et al., "Enhancement of antiviral activity against hepatitis C virus in vitro by interferon combination therapy," Antiviral Research 65:23-34 (2005).

Orkin et al., "Report and Recommendations of the Panel to Assess the NIH Investment in Research on Gene Therapy," (1995).

Osborn et al., "A Picornaviral 2A-like sequence-based tricistronic vector allowing for high-level therapeutic gene expression coupled to a dual-reporter system," Mol. Ther. 12: 569-574 (2005).

Overwijk et al., "Vaccination with a recombinant vaccinia virus enclding a 'self' antigen induces autoimmune vitiligo and tumor cell destruction in mice: Requirement for $CD4^+$ T lymphocytes," Proc. Natl. Acad. Sci. USA 96:2982-2987 (1999).

Özbek et al., "The designer cytokine hyper-IL-6 mediates growth inhibition and GM-CSF-dependent rejection of B16 melanoma cells," Oncogene 20(8):972-979 (2001).

Pak et al., "Cloning of the growth factor gene from vaccinia virus LIVP strain in *Escherichia coli* cells," Mol Gen Mikrobiol Virusol Sep.-Oct.; (9-10):19-21 (1992).

Paniacli et al., "Vaccinia virus vectors utilizing the /?-galactosidase assay for rapid selection of recombinant viruses and measurement of gene expression," Gene 47:193-199 (1986).

Paoletti et al., "Applications of pox virus vectors to vaccination: An update," Proc. Natl. Acad. Sci. 93:11349-11353 (1996).

Parato et al., "Recent progress in the battle between oncolytic viruses and tumours," Nature Rev. 5:965-976 (2005).

Parks et al., "Analysis of the noncoding regions of measles virus strains in the Edmonston vaccine lineage," J. Virol. 75(2):921-933 (2001).

Parrish, S. and B. Moss, "Characterization of a vaccinia virus mutant with a deletion of the D10R gene encoding a putative negative regulator of gene expression," J Virol. Jan. 2006;80(2):553-61.

Patel et al., "A poxvirus-derived vector that directs high levels of expression of cloned genes in mammalian cells," Proc Natl Acad Sci U S A. 85(24):9431-9435 (1988).

Paul et al., "Redirected cellular cytotoxicity by infection of effector cells with a recombinant vaccinia virus encoding a tumor-specific monoclonal antibody," Cancer Gene Ther. 7(4):615-623 (2000).

Pearson et al., "Improved tools for biological sequence comparison," Proc. Natl. Acad. Sci. USA 85:2444-2448 (1988).

Pecora, A.L. et al., "Phase I Trial of Intravenous Administration of PV701, an Oncolytic Virus, in Patients With Advanced Solid Cancers", Journal of Clinical Oncology, 20(9): 2251-2266 (2002).

Peplinski et al., "In vivo gene therapy of a murine pancreas tumor with recombinant vaccinia virus encoding human interleukin-1beta," Surgery 118:185-191 (1995).

Peplinski et al., "Prevention of murine breast cancer by vaccination with tumor cells modified by cytokine-producing recombinant vaccinia viruses" Annals Surg. Oncol. 3(1):15-23 (1996).

Peplinski, G.R. et al., "Vaccinia Virus for Human Gene Therapy", Surgical Oncology Clinics of North America, 7(3): 575-588 (1998).

Perkus et al., "Deletion of 55 open reading frames from the termini of vaccinia virus", Virology 180:406-410 (1991).

Perkus et al. "Recombinant Vaccinia Virus: Immunization Against Multiple Pathogens," Science 229(4717):981-984 (1985).

Pfeifer, A., and I. Verma, "Gene therapy: promises and problems," Annual Review of Genomics and Human Genetics 2:177-211 (2001).

Pfleiderer et al., "A novel vaccinia virus expression system allowing construction of recombinants without the need for selection markers, plasmids and bacterial hosts," J. General Virology 76:2957-2962 (1995).

Pfleiderer et al., "Requirements for optimal expression of secreted and nonsecreted recombinant proteins in vaccinia virus systems," Protein Expr Purif. 6(5):559-569 (1995).

Pinkert et al., "An albumin enhancer located 10 kb upstream functions along with its promoter to direct efficient, liver-specific expression in transgenic mice," Genes & Dev. 1:268-76 (1987).

Plucienniczak et al., "Nucelotide sequence of a cluster and late genes in a conserved segment of the vaccinia virus genome," Nucleic Acids Research 13(3):993-998 (1985).

Pluen, A. et al., "Role of tumor-host interactions in interstitial diffusion of macromolecules: Cranial vs. subcutaneous tumors," Proc. Natl. Acad. Sci. U.S.A., 98(8): 4628-4633 (2001).

Prasher et al., "Sequence Comparison of Complementary DNAs Encoding Aequorin Isotypes," Biochemistry 26: 1326-1332 (1987).

Prikhod'ko, G. G. and IV Babkin, "5'-variable genome sequence of vaccinia virus LIVP. Possible role of short direct repeats in formation of DNA deletions," Genetika 27(1): 13-26 (1991).

Prikhod'ko, G. G. et al., "Cloning, Sequencing and Translation Analysis of the Vaccinia Virus LIVP HindIII N Fragment," Genetika 27(6): 955-963 (1991).

Puhlmann et al., "Thymidine kinase-deleted vaccinia virus expressing purine nucleoside phosphorylase as a vector for tumor-directed gene therapy," Hum Gene Ther. 10(4):649-657 (1999).

Puhlmann et al., "Vaccinia virus as a vector for tumor-directed gene therapy: biodistribution of a thymidine kinase-deleted mutant," Cancer Gene Therapy 7(1): 66-73 (2000).

Qin, H. and S. Chatterjee, "Cancer gene therapy using tumor cells infected with recombinant vaccinia virus expressing GM-CSF," Human Gene Ther. 7:1853-1860 (1996).

Qin et al., "Construction of recombinant vaccinia virus expressing GM-CSF and its use as a tumor vaccine" Gene Ther. 3(1):59-66 (1996).

Quesada et al., "Playing only one instrument may be not enough: limitations and future of the antiangiogenic treatment of cancer," Bioessays 29(11):1159-1168 (2007).

Ramirez et al., "Biology of attenuated modified vaccinia virus Ankara recombinant vector in mice: Virus fate and activation of B- and T-Cell immune responses in comparsion with the Western Reserve Strain and advantages as a vaccine," J. Virol. 74(2):923-933 (2000).

Ramirez et al., "Tissue distribution of the Ankara strain of vaccinia virus (MVA) after mucosal or systemic administration," Arch. Virol. 148:827-839 (2003).

Rathinavelu et al., "Expression of mdm-2 oncoprotein in the primary and metastatic sites of mammary tumor (GI-101) implanted athymic nude mice," Cancer Biochem. Biophys. 17:133-146 (1999).

Rao et al., "Il-12 is an effective adjuvant to recombinant vaccinia virus-based tumor vaccines," J. Immunol. 156: 3357-3365 (1996).

Reali et al., "Comparative studies of Avipox GM-CSF versus recombinant GM-CSF protein as immune adjuvants with different vaccine platforms" Vaccine 23(22):2909-2921 (2005).

Reddy et al. "Folate-mediated targeting of therapeutic and imaging agents to cancers," Crit Rev Ther Drug Carrier Syst. 15(6):587-627 (1998).

Rehemtulla et al., "Rapid and quantitative assessment of cancer treatment response using in vivo bioluminescence imaging," Neoplasia, 2(6):491-495 (2000).

Reno, F., "Non-clinical Toxicology", Principles and Practice of Pharmaceutical Medicine, A.J. Fletcher et al.(eds.), ch.6: 55-64 (c2002) John Wiley & Sons Ltd.

Ribas et al., "Current Developments in Cancer Vaccines and Cellular Immunotherapy", Journal of Clinical Oncology, 21(12): 2415-2432 (2003).

Ring, C., "Cytolytic viruses as potential anti-cancer agents," J. Gen. Virol., 83: 491-502 (2002).

Rizzo et al., "An improved cyan fluorescent protein variant useful for FRET," Nat Biotechnol. 22(4):445-449 (2004).

Rodriguez et al., "Highly attenuated vaccinia virus mutants for the generation of safe recombinant viruses," Proc. Natl. Acad. Sci. USA 86: 1287-1291 (1989).

Rodriguez, J.F. et al., "Expression of the firefly luciferase gene in vaccinia virus: A highly sensitive gene marker to follow virus dissemination in tissues of infected animals," Proc. Natl. Acad. Sci. U.S.A. 85:1667-1671 (1988).

Roenigk et al., "Immunotherapy of malignant melanoma with vaccinia virus," Arch Dermatol 109:668-673 (1977).

Roper, R.L. "Characterization of the Vaccinia Virus A35R Protein and Its Role in Virulence" J. Virol. 80(1) 306-313 (2006).

Roseman et al., "The vaccinia virus HindIII fragment:nucleotide sequence of the left 6.2kb," Virology 178: 410-418 (1990).

Roth et al,, "p53 as a target for cancer vaccines: recombinant canarypox virus vectors expressing p53 protect mice against lethal tumor cell challenge," Proc. Natl. Acad. Sci. USA 93: 4781-4786 (1996).

Rothenberg et al., "Improving the evaluation of new cancer treatments: challenges and opportunities," Nat. Rev. Cancer, 3: 303-309 (2003).

Rottger et al., "Interactions between vaccinia virus IEV membrane proteins and their roles in IEV assembly and actin tail formation," J Virol. Apr. 1999;73(4):2863-2875 (1999).

Rubanyi et al., "The future of human gene therapy" Molecular Aspects of Medicine 22:113-142 (2001).

Rudinger, "Characteristics of the amino acids as components of a peptide hormone sequence", Peptide Hormones, Parsons, University Park Press, Baltimore, p. 1-7 (1976).

Sanchez-Puig et al., "Susceptibility of different leukocyte cell types to Vaccinia virus infection," Virol. J. 1:10-17 (2004).

Sanderson et al., "Roles of vaccinia virus EEV-specific proteins in intracellular actin tail formation and low pH-induced cell-cell fusion," J Gen Virol. Jun. 1998;79 ( Pt 6):1415-1425 (1998).

Sauthoff et al., "Late expression of p53 from a replicating adenovirus improves tumor cell killing and is more tumor cell specific than expression of the adenoviral death protein," Human Gene Therapy 13(15):1859-1871 (2002).

Schmidt et al., "Generation of effective cancer vaccines genetically engineered to secrete cytokines using adenovirus-enhanced transferrinfection (AVET)," Gene. 190(1):211-216 (1997).

Scholl et al., "Recombinant Vaccinia Virus Encoding Human MUC1 and IL2 as Immunotherapy in Patients with Breast Cancer," J. Immunother 23(5):570-580 (2000).

Schwartz and Dayhoff, eds., Atlas of Protein Sequence and Structure, National Biomedical Research Foundation, pp. 353-358 (1979).

Shaner et al., "A guide to choosing fluorescent proteins," Nat Methods. 2(12):905-909 (2005).

Shapiro, D. and A. Fox, "Biotechnology Products and Their Development", Principles and Practice of Pharmaceutical Medicine, A.J. Fletcher, et al.(eds.), ch.17: 191-201, c2002 John Wiley & Sons.

Shariatmadari et al., "Improved technique for detection of enhanced green fluorescent protein in transgenic mice," Biotechniques 30:1282-1285 (2001).

Shata et al., "Optimization of recombinant vaccinia-based ELISPOT assay," J. Immunological Methods 283: 281-289 (2003).

Shchelkunov et al., "The gene encoding the late nonstructural 36K protein of vaccinia virus is essential for virus reproduction," Virus Research 28: 273-283 (1993).

Shen et al., "Fighting cancer with vaccinia virus: Teaching new tricks to an old dog," Mol. Therapy 11(2):180-195 (2005).

Shenk, T., "Delivery systems for gene therapy: the adenovirus," Stem Cell Biology and Gene Therapy, Quesenberry, P.J. et al. (Eds.), ch.6: pp. 161-178, c1998 Wiley-Liss, Inc.

Shepherd, A.J., "Good Laboratory Practice in the Research and Development Laboratory," Gene Therapy Technologies, Applications and Regulations, A. Meager (Ed.), ch.19: 375-381 (c1999) John Wiley & Sons Ltd.

Shida et al., "Effects and virulences of recombinant vaccinia viruses derived from attenuated strains that express the human T-cell leukemia virus type I envelope gene," J. Virol. 62(12):4474-4480 (1988).

Shimizu et al, "Significance of priming of hosts with virus in the tumor-specific immunotherapy model utilizing virus-reactive helper T cell activity," Nippon Gan Chiryo Gakkai Shi. May 20, 1989;24(5):1007-14.

Shimizu et al., "Immunotherapy of tumor-bearing mice utilizing virus help," Cancer Immunol Immunother. 27(3):223-227 (1988).

Shinozaki et al., "Oncolysis of multifocal hepatocellular carcinoma in the rat liver by hepatic artery infusion of vesicular stomatitis virus," Mol. Ther. 9(3): 368-376 (2004).

Shinozaki et al., Eradication of advanced hepatocellular carcinoma in rats via repeated hepatic arterial infusions of recombinant VSV. Hepatology. 41(1):196-203 (2005).

Shkrob et al., "Far-red fluorescent proteins evolved from a blue chromoprotein from actinia equine," Biochem J. 392(Pt 3):649-654 (2005).

Shors et al., "Down regulation of gene expression by the vaccinia virus D10 protein," J Virol. 73(1):791-796 (1999).

Sinkovics, J. and J. Horvath, "New Developments in the Virus Therapy of Cancer: A Historical Review," Intervirology, 36: 193-214 (1993).

Sinkovics, J. and J. Horvath, "Virus therapy of human cancers," Melanoma Research 13:431-432 (2003).

Sivanandham et al., "Therapeutic effect of a vaccinia colon oncolysate prepared with interleukin-2-gene encoded vaccinia virus studied in a syngeneic CC-36 murine colon hepatic metastasis model" Cancer Immunological Immunotherapy 38:259-264 (1994).

Sivanandham et al., "Colon cancer cell vaccine prepared with replication-deficient vaccinia viruses encoding B7.1 and interleukin-2 induce antitumor response in syngeneic mice," Cancer Immunol Immunother 46(5):261-7 (1998).

Skolnick et al., "From genes to protein structure and function: novel applications of computational approaches in the genomic era" Trends in Biotech. 18:34-39 (2000).

Slezak et al., "YY1 is recruited to the cytoplasm of vaccinia virus-infected human macrophages by the Crm1 system," Virus Res. 102(2):177-184 (2004).

Smee et al., "Effects of cidofovir on the pathogenesis of a lethal vaccinia virus respiratory infection in mice," Antivir. Res., 52: 55-62 (2001).

Smirne et al., "[Vascular endothelial growth factor. From basic research to clinical application]," Minerva Med 90(1-2):15-23 (1999).

Smith et al., "Host range selection of vaccinia recombinants containing insertions of foreign genes into non-coding sequences," Vaccine 11(1):43-53 (1993).

Smith et al. "Immune response to poxvirus infections in various animals," Crit. Rev. Microbiol. 28(3):149-85 (2002).

Smith, G. and B. Moss, "Infectious poxvirus vectors have capacity for at least 25000 base pairs of foreign DNA," Gene 25: 21-28 (1983).

Smith et al., "The formation and function of extracellular enveloped vaccinia virus," J Gen Virol. 83(Pt 12):2915-2931 (2002).

Smith, T. and M. Waterman, "Comparison of biosequences," Adv. Appl. Math. 2:482-489 (1981).

Smith et al., "Vaccinia virus immune evasion," Immunol Rev. 159:137-154 (1997).

Smith, G. and A. Vanderplasschen, "Extracellular enveloped vaccinia virus. Entry, egress, and evasion," Adv Exp Med Biol. 440:395-414 (1998).

Somia, N. and I. Verma, "Gene Therapy: Trial and Tribulations," Nat. Rev. Genet. 1(2): 91-99 (2000).

Sroller et al., "Effect of 3-beta-hydroxysteroid dehydrogenase gene deletion on virulence and immunogenicity of different vaccinia viruses and their recombinants" Arch. Virol. 143:1311-1320 (1998).

Steele et al., "Recent developments in the virus therapy of cancer," P.S.E.B.M. 223:118-127 (2000).

Stienlauf et al., "Kinetics of formation of neutralizing antibodies against vaccinia virus following re-vaccination," Vaccine 17:201-204 (1999).

Stojdl et al., "VSV strains with defects in their ability to shutdown innate immunity are potent systemic anti-cancer agents", Cancer Cell, 4:263-275 (2003).

Stritzker et al., "Evaluation of an in vivo gene induction system in infected tumor-bearing mice" Proceedings of the 14th International Symposium on Bioluminescence & Chemiluminescence: Chemistry, Biology and Applications. World Scientific: Singapore: 205-208 (2007).

Su et al. "The cancer growth suppressor gene mda-7 selectively induces apoptosis in human breast cancer cells and inhibits tumor growth in nude mice" Proc. Natl. Acad. Sci. 95:14400-14405 (1998).

Sugimoto et al., "Gene structures of low-neurovirulent vaccinia virus LC16m0, LC16m8, and their Lister Original (LO) strains," Microbial. Immuol. 29:421-428 (1985).

Sugimoto, M. and K. Yamanouchi, "Characteristics of an attenuated vaccinia virus strain, LC16m0, and its recombinant virus vaccines," Vaccine 12(8):675-681 (1994).

Sui et al., "Cell Cycle-Dependent Antagonistic Interactions between Paclitaxel and gamma-Radiation in Combination Therapy," Clin. Canc. Res. 10:4848-4857 (2004).

Sutter et al., "Vaccinia vectors as candidate vaccines: The development of modified vaccinia virus Ankara for antigen delivery" Current Drug Targets—Infectious Disorders 3(3):263-271 (2003).

Symons, J.A. et al., "A study of the vaccinia virus interferon-y receptor and its contribution to virus virulence", Journal of General Virology, 83: 1953-1964 (2002).

Takahashi-Nishimaki et al., "Genetic analysis of vaccinia virus Lister strain and its attenuated mutant LC16m8: production of intermediate variants by homologous recombination," J. Gen. Virol. 68: 2705-2710 (1987).

Tartaglia et al., "NYVAC: a highly attenuated strain of vaccinia virus," Virology 188(1):217-232 (1992).

Taylor et al., "Comparison of the virulence of wild-type thymidine kinase (tk)-deficient and tk+ phenotypes of vaccinia virus recombinants after intranasal inoculation of mice," J. Gen. Virol. 72 (Pt 1):125-130 (1991).

Technology Evaluation Center, "Special Report: Vaccines for the Treatment of Malignant Melanoma," TEC Assessment Program 16(4): 1-46 (2001).

Theon et al., "Intratumoral chemotherapy with cisplatin inj oily emulsion in horses," J. Am. Vet. Med. Assoc. 202(2): 261-267 (1993).

Thorne et al., "Future directions for the field of oncolytic virotherapy: a perspective on the use of vaccinia virus" Expert Opin Biol Ther 4(8): 1307-1321 (2004).

Thorne, S.H., et al. "Rational strain selection and engineering creates a broad-spectrum, systemically effective oncolytic poxvirus, JX-963," J. Clin. Invest. 117:3350-3358. (2007).

Thorne et al., "Synergestic antitumor effects of immune cell-viral biotherapy," Science 311:1780-1784 (2006).

Thorne et al., "The use of oncolytic vaccinia viruses in the treatment of cancer: a new role for an old ally?" Curr. Gene Ther. 5:429-443 (2005).
Timiriasova et al., "[Analysis of reporter gene expression at different segments of the vaccinia virus genome]," Mol. Biol. (Mosk.) 27(2): 392-401 (1993).
Timiryasova et al., "Construction of recombinant vaccinia viruses using PUV-inactivated virus as a helper," BioTechniques 31:534-540 (2001).
Timiryasova et al., "Antitumor Effect of Vaccinia Virus in Glioma Model" Oncology Research, 11(3):133-144 (1999).
Timiryasova et al., "Visualization of Vaccinia Virus Infection Using the Renilla-Luciferase-GFP Fusion Protein", Bioluminescence & chemiluminescence: Proceedings of the 11th International Symposium on Bioluminescence Chemiluminescence: Asilomar Conference Grounds, Pacific Grove, Monterey, California: Sep. 6-10, 2000 / (eds.): Case, J.F. et al., World Scientific Publishing Co. (c2001), pp. 457-460.
Timiryasova et al., "Replication-deficient vaccinia virus gene therapy vector: evalution of exogenous gene expression mediated by PUV-inactivated virus in glioma cells," Journal of Gene Medicine 3:468-477 (2001).
Timiryasova et al., "Vaccinia virus-mediated expression of wild-type p53 suppresses glioma cell growth and induces apoptosis," Int J Oncol. 14(5):845-54 (1999).
Tjuvajev et al., "Imaging Adenoviral-mediated Herpes Virus Thymidine Kinase Gene Transfer and Expression in Vivo," Cancer Research 59:5186-5193 (1999).
Tjuvajev et al., "Imaging Herpes Virus Thymidine Kinase Gene Transfer and Expression by Positron Emission Tomography," Cancer Res. 58(19):4333-4341 (1998).
Toguchi et al., "Suicide Gene Therapy of C6 Glioma Cells Mediated by Replication-Deficient and Replication Competent Vaccinia Viruses," Cancer Gene Therapy 10: S32 (2003) presented at the Eleventh International Conference on Gene Therapy of Cancer, Dec. 12-14, 2002, San Diego California.
Tromp et al., "Tumor angiogenesis factors reduce leukocyte adhesion in vivo," Int Immunol. 12(5):671-676 (2000).
Tscharke et al., "A model for vaccinia virus pathogenesis and immunity based on intradermal injection of mouse ear pinnae," J. Gen. Virol., 80: 2751-2755 (1999).
Tscharke et al., "Dermal infection with vaccinia virus reveals roles for virus proteins not seen using other inoculation routes," Journal of General Virology, 83: 1977-1986 (2002).
Tsung et al., "Gene expression and cytopathic effect of vaccinia virus inactivated by psoralen and long-wave UV light," J. Virol. 70: 165-171 (1996).
Umphress et al., "Vaccinia virus mediated expression of human APC induces apoptosis in colon cancer cells," Transgenics 4:19-33 (2003).
Upton et al., "Poxvirus orthologous clusters: toward defining the minimum essential poxvirus genome," J. Virol. 77(13):7590-7600 (2003).
Vanderplasschen et al., "Antibodies against vaccinia virus do not neutralize extracellular enveloped virus but prevent virus release from infected cells and comet formation," J Gen Virol. Aug. 1997;78 (Pt 8):2041-2048 (1997).
Vanderplasschen et al., "Extracellular enveloped vaccinia virus is resistant to complement because of incorporation of host complement control proteins into its envelope," Proc Natl Acad Sci U S A. 95(13):7544-7549 (1998).
Vanderplasschen et al., "Intracellular and extracellular vaccinia virions enter cells by different mechanisms," Journal of General Virology 79:877-887 (1998).
Veeravagu et al., "Vascular endothelial growth factor and vascular endothelial growth factor receptor inhibitors as anti-angiogenic agents in cancer therapy," Recent Patents Anticancer Drug Discov 2(1):59-71 (2007).
Vento, S. and F. Cainelli, "Infections in patients with cancer undergoing chemotherapy: aetiology, prevention, and treatment," Lancet 4:595-604 (2003).
Verma et al., "Gene therapy—promises, problems and prospects," Nature 389:239-242 (1997).

Vidal et al., "Tissue-specific control elements of the Thy-1 gene," EMBO J. 9(3):833-840 (1990).
Vile et al., "The oncolytic virotherapy treatment platform for cancer: Unique biological and biosafety points to consider," Cancer Gene Therapy, 9: 1062-1067 (2002).
Vitaliti et al., "Inhibition of tumor angiogenesis by a single-chain antibody directed against vascular endothelial growth factor," Cancer Research 60:4311-4314 (2000).
Wallack et al., "A phase III randomized, double-blind, multiinstitutional trial of vaccinia melanoma oncolysate-active specific immunotherapy for patients with stage II melanoma," Cancer 75(1):34-42 (1995).
Wallack et al., "Increased Survival of Patients Treated With a Vaccinia Melanoma Oncolysate Vaccine," Annals of Surgery, 226(2): 198-206 (1997).
Wallack et al., "Surgical adjuvant active specific immunotherapy for patients with stage III melanoma: the final analysis of data from a phase III, randomized, double-blind, multicenter vaccinia melanoma oncolysate trial," J. Am. Coll. Surg. 187(1):69-79 (1998).
Wang et al., "Evolution of new nonantibody proteins via iterative somatic hypermutation," Proc Natl Acad Sci U S A. 101(48):16745-16749 (2004).
Wang et al., "Clonal persistence and evolution during a decade of recurrent melanoma," J. Invest. Dermatol. 126:1372-1377 (2006).
Ward et al., "Mapping and functional analysis of interaction sites within the cytoplasmic domains of the vaccinia virus A33R and A36R envelope proteins," J Virol. 77(7):4113-4126 (2003).
Watson et al. Molecular Biology of the Gene, 4th Edition, 1987, The Benjamin/Cummings Pub. co., p. 224.
Weng et al., "HO-1 expression in type II pneumocytes after transpulmonary gene delivery" Am. J. Physiol. Lung Cell Mol. Physol 278:L1273-L1279 (2000).
Wharton et al., "Recommendations for Using Smallpox Vaccine in a Pre-Event Vaccination Program", MMWR, 52(RR-7):1-16 (2003).
Whitley, R., "Smallpox: a potential agent of bioterrorism," Antiviral Research 57:7-12 (2003).
Wiedenmann et al., "A far-red fluorescent protein with fast maturation and reduced oligomerization tendency from Entacmaea quadricolor (Anthozoa, Actinaria)," Proc Natl Acad Sci U S A. 99(18):11646-11651 (2002).
Wilcock et al., "The vaccinia virus A4OR gene product is a nonstructural, type II membrane glycoprotein that is expressed at the cell surface," J Gen Virol. 80( Pt 8):2137-2148 (1999).
Willenborg, D., "Cytokines and murine autoimmune encephalomyelitis: inhibition or enhancement of disease with antibodies to select cytokines, or by delivery of exogenous cytokines using a recombinant vaccinia virus system," Scandinavian Journal of Immunology 41(1):31-41 (1995).
Willett et al., "Direct evidence that the VEGF-specific antibody bevacizumab has antivascular effects in human rectal cancer," Nat Med 10(2):145-147 (2004).
Williams, W., "Southwestern internal medicine conference: prospects for gene therapy of ischemic heart disease," The American Journal of the Medical Sciences 306(2):129-136 (1993).
Wirtz et al., "Efficient gene delivery to the inflamed colon by local administration of recombinant adenoviruses with normal or modified fibre structure," Gut 44:800-807 (1999).
Wisher, M., "Biosafety and product release testing issues relevant to replication-competent oncolytic viruses," Cancer Gene Therapy, 9: 1056-1061 (2002).
Wittrup, D., "Tumor Targeting Theory", IBC's 15th Annual International Antibody Engineering Conference entitled Antibody Engineering: Forging the Future of Antibody Therapeutics, Nov. 30-Dec. 3, 2003—The Paradise Point Resort—San Diego, CA, pp. 1-17.
Wlodaver et al., "Laboratory-acquired vaccinia infection," Journal of Clinical Virology, xxx: 1-5 (2003).
Wolffe et al., "Deletion of the vaccinia virus B5R gene encoding a 42-kilodalton membrane glycoprotein inhibits extracellular virus envelope formation and dissemination," Journal of Virology 67(8): 4732-4741 (1993) and erratum in Journal of Virology, vol. 67, pp. 5709-5711 (1993).

Wolffe et al., "Role for the vaccinia virus A36R outer envelope protein in the formation of virus-tipped actin-containing microvilli and cell-to-cell virus spread," Virology. 244(1):20-26 (1998).

Wolffe et al., "The A34R glycoprotein gene is required for induction of specialized actin-containing microvilli and efficient cell-to-cell transmission of vaccinia virus," J Virol. 71(5):3904-3915 (1997).

Wolffe et al., "The vaccinia virus A33R protein provides a chaperone function for viral membrane localization and tyrosine phosphorylation of the A36R protein," J Virol. 75(1):303-310 (2001).

Woo et al., "Advances in oncolyticviral therapy," Curr. Opin. Investig. Drugs 7, 549-559 (2006).

Wood et al., "Complementary DNA coding click beetle luciferases can elicit bioluminescence of different colors," Science 244(4905):700-702 (1989).

Wright, C., "An in vitro transcription system for studying vaccinia virus late genes," Methods Mol Biol. 269:143-150 (2004).

Wright et al., "Vaccinia virus late transcription is activated in vitro by cellular heterogeneous nuclear ribonucleoproteins," J Biol Chem. 276(44):40680-40686 (2001).

Wu et al., "A vaccinia replication system for producing recombinant hepatitis C virus," World J. Gastroenterology 10(18):2670-2674 (2004).

Wu et al., "High resolution microPET imaging of carcino-embryonic antigen-positive xenografts by using a copper-64-labeled engineered antibody fragment," Proc Natl Acad Sci U S A. 97(15):8495-8500 (2000).

Xiang et al., "The vaccinia virus A18R DNA helicase is a postreplicative negative transcription elongation factor," J Virol. 72(9):7012-7023 (1998).

Xiong et al., "Cell cycle dependent antagonistic interactions between Paclitaxel and Carboplatin in combination therapy," Cancer Biology Therapy 6(7):1067-1073 (2007).

Yamamoto et al., "Concentrations of vascular endothelial growth factor in the sera of normal controls and cancer patients," Clin Cancer Res 2(5):821-826 (1996).

Yang et al., "Visualizing gene expression by whole-body fluorescence imaging," Proc Natl Acad Sci U S A. 97(22):12278-12282 (2000).

Yu et al., "A Renilla luciferase-Aequorea GFP (ruc-gfp) fusion gene construct permits real-time detection of promoter activation by exogenously administered mifepristone in vivo," Mol Genet Genomics. 268(2):169-178 (2002).

Yu et al., "Optical imaging: bacteria, viruses, and mammalian cells encoding light-emitting proteins reveal the locations of primary tumors and metastases in animals," Anal Bioanal Chem. 377(6):964-972 (2003).

Yu Y., "Visualization of molecular and cellular events with green fluorescent proteins in developing embryos:a review," Luminescence. 18(1):1-18 (2003) Erratum in: Luminescence. Jul.-Aug. 2003;18(4):243.

Yu et al. "Visualization of tumors and metastases in live animals with bacteria and vaccinia virus encoding light-emitting proteins," Nat Biotech. 22(3): 313-320 (2004).

Zeh, H. and D. Bartlett, "Development of a replication-selective, oncolytic poxvirus for the treatment of human cancers," Cancer Gene Therapy, 9:1001-1012 (2002).

Zhang et al., "Eradication of solid human tumors in nude mice with an intravenously injected light emitting oncolytic vaccinia virus," Cancer Res. 67(20):10038-10046 (2007).

Zhang et al., "The pattern of monocyte recruitment in tumors is modculated by MCP-1 expression and influences the rate of tumor growth," Lab Invest. 76(4):579-590 (1997).

Zhao et al., "Potent antitumor activity of oncolytic adenovirus expressing mda-7/IL-24 for colorectal cancer," Human Gene Therapy 16:845-858 (2005).

Zinn et al., "Simulataneous evaluation of dual gene transfer to adherent cells by gamma-ray imaging," Nuclear Medicine and Biology 28(2):135-144 (2001).

Zinoviev et al., "Identification of the gene encoding vaccinia virus immunodominant protein p35," Gene 147: 209-214 (1994).

Blechacz et al., "Engineered measles virus as a novel oncolytic viral therapy system for hepatocellular carcinoma," Hepatology 44(6):1465-1477 (2006).

Ferrara et al., "Bevacizumab (Avastin), a humanized anti-VEGF monoclonal antibody for cancer therapy," Biochem. Biophys. Res. Comm. 333:328-335 (2005).

Galmiche et al., "Expression of a functional single chain antibody on the surface of extracellular enveloped vaccinia virus as a step towards selective tumour cell targeting," J. Gen. Virol. 78:3019-3027 (1997).

Hung et al., "Vaccinia virus preferentially infects and controls human and murine ovarian tumors in mice," Gene Ther. 14:20-29 (2007).

Kozin et al., "Vascular endothelial growth factor receptor-2-blocking antibody potentiates radiation-induced long-term control of human tumor xenografts," Cancer Res. 61:39-44 (2001).

Lee et al., "Anti-vascular endothelial growth factor treatment augments tumor radiation response under normoxic or hypoxic conditions," Cancer Res. 60:5565-6670 (2000).

Chalikonda et al., "Chapter 4: Vaccinia and Pox-Virus," in: Cancer Drug Discovery and Development: Gene Therapy for Cancer, edited by K.K. Hunt et al., Humana Press Inc., Totowa, NJ, pp. 73-85 (2007).

Dubensky, T., "(Re-)engineering tumor cell-selective replicating adenoviruses: a step in the right direction toward systemic therapy for metastatic disease," Cancer Cell 1:307-309 (2002).

Fisher, K., "Striking out at disseminated metastases: the systemic delivery of oncolytic viruses," Curr. Opin. Mol. Ther. 8(4):301-313 (2006).

Lei et al., "An oncolytic adenovirus expressing granulocyte macrophage colony-stimulating factor shows improved specificity and efficacy for treating human solid tumors," Cancer Gene Ther. 16:33-43 (2009).

Toyoizumi et al., "Combined therapy with chemotherapeutic agents and herpes simplex virus type I ICP34.5 mutant (HSV-1716) in human non-small cell lung cancer," Human Gene Ther. 10:3013-3029 (1990).

Office Action, issued Apr. 8, 2010, in connection with U.S. Appl. No. 12/218,953.

Office Action, issued Sep. 1, 2010, in connection with U.S. Appl. No. 12/080,766.

Office Action, issued Jan. 13, 2011, in connection with U.S. Appl. No. 12/218,953.

Gentschev et al., "Regression of human prostate tumors and metastases in nude mice following treatment with the recombinant oncolytic vaccinia virus GLV-1h68," J. Biomed. Biotechnol. 2010:1-11 (2010).

Hoffman et al., "Vaccinia virus GLV-1h237 carrying a Walker A motif mutation of mouse Cdc6 protein enhances human breast tumor therapy in mouse xenografts," Int. J. Oncol. 38(3):871-878 (2011) [Published online Jan. 18, 2011].

Seubert et al., "Enhanced tumor therapy using vaccinia virus strain GLV-1h68 in combination with a β-galactosidase-activatable prodrug seco-analog of duocarmycin SA," Cancer Gene Ther. 18:42-52 (2011).

International Preliminary Report on Patentability, issued Feb. 9, 2006, in connection with International Patent Application No. PCT/US04/19866.

Office Action, issued Oct. 25, 2006, in connection with U.S. Appl. No. 10/872,156.

Office Action, issued Nov. 27, 2006, in connection with U.S. Appl. No. 10/866,606.

Office Action, issued Dec. 18, 2006, in connection with U.S. Appl. No. 11/238,025.

Office Action, issued Jul. 31, 2007, in connection with U.S. Appl. No. 10/872,156.

Office Action, issued Nov. 19, 2007, in connection with U.S. Appl. No. 10/485,179.

Office Action, issued Nov. 28, 2007, in connection with U.S. Appl. No. 11/529,662.

Office Action, issued Dec. 6, 2007, in connection with U.S. Appl. No. 11/238,025.

Office Action, issued Dec. 21, 2007, in connection with Canadian Patent Application No. 2,527,225.

Office Action, issued Jan. 28, 2008, in connection with U.S. Appl. No. 10/516,785.

Office Action, issued Mar. 18, 2008, in connection with U.S. Appl. No. 10/866,606.

Office Action, issued Apr. 1, 2008, in connection with U.S. Appl. No. 11/796,028.

Office Action, issued Apr. 3, 2008, in connection with U.S. Appl. No. 11/796,027.

Office Action, issued May 12, 2008, in connection with U.S. Appl. No. 10/872,156.

Office Action, issued Dec. 18, 2008, in connection with U.S. Appl. No. 10/866,606.

Office Action, issued Feb. 2, 2009, in connection with U.S. Appl. No. 11/796,027.

Office Action, issued Feb. 25, 2009, in connection with U.S. Appl. No. 11/529,662.

International Search Report, issued Mar. 25, 2009, in connection with International Patent Application No. PCT/US2007/22172.

Office Action, issued Jun. 10, 2009 in connection with U.S. Appl. No. 12/148,542.

Office Action, issued Nov. 9, 2009, in connection with U.S. Appl. No. 11/982,102.

Office Action, issued Nov. 16, 2009 in connection with U.S. Appl. No. 11/982,035.

Office Action, issued Dec. 2, 2009 in connection with U.S. Appl. No. 12/080,766.

Brader et al, "Imaging genetically engineered oncolytic vaccinia virus (GLV-1h99) using a human norepinephrine transporter reporter gene," Clin. Cancer Res. 15(11):3791-3801 (2009).

ClinicalTrials.gov, "Safety study of GL-ONC1, an oncolytic virus, in patients with advanced solid tumors," retrieved from the Internet:<URL: clinicaltrials.gov/ct2/show/NCT00794131?term=genelux&rank=1, [retrieved on Dec. 2, 2008] [4 pages].

Emens, "Cancer vaccines:on the threshold of success," Expert Opin. Emerg. Drugs 13(2):295-308 (2008).

Frentzen et al., "Anti-VEGF single chain antibody GLAF-1 encoded by oncolytic vaccinia virus significantly enhances antitumor therapy," Proc. Natl. Acad. Sci. U.S.A. 106(31):12915-12920 (2009).

Gentschev et al., "Use of an oncolytic vaccinia virus for treatment of canine breast cancer in nude mice: preclinical development of a therapeutic agent", Cancer Gene Ther. 16(4):320-328 (2009).

Kelly et al., "Novel oncolytic agent GLV-1h68 is effective against malignant pleural mesothelioma," Hum. Gene Ther. 19(8):774-82 (2008).

Kelly et al., "Real-time intraoperative detection of melanoma lymph node metastases using recombinant vaccinia virus GLV-1h68 in an immunocompetent animal model," Int. J. Cancer 124(4):911-918 (2009).

Li et al., "Oncolytic virotherapy as personalized cancer vaccine," Int. J. Cancer 123:493-499 (2008).

Lin et al., "Oncolytic vaccinia virotherapy of anaplastic thyroid cancer in vivo," J. Clin. Endocrinol. Metab. 93:4403-4407 (2008).

Lin et al., "Treatment of anaplastic thyroid carcinoma in vitro with a mutant vaccinia virus," Surgery 142(6):976-83 (2007).

Presta et al., "Humanization of an anti-vascular endothelial growth factor monoclonal antibody for the therapy of solid tumors and other disorders," Cancer Res. 57:4593-4599 (1997).

Worschech et al., "The immunologic aspects of poxvirus oncolytic therapy," Cancer Immunol. Immunother. 58(9):1355-1362 (2009).

Worschech et al., "Systemic treatment of xenografts with vaccinia virus GLV-1h68 reveals the immunologic facet of oncolytic therapy," BMC Genomics 10:301 (2009).

Yu et al., "Oncolytic vaccinia therapy of squamous cell carcinoma," Mol. Cancer 8:45 (2009).

Zhang et al., "The highly attenuated oncolytic recombinant vaccinia virus GLV-1h68: comparative genomic features and the contribution of F14.5L inactivation," Mol. Genet. Genomics 282(4):417-435 (2009).

* cited by examiner

_US 8,052,968 B2_

MODIFIED VACCINIA VIRUS STRAINS FOR USE IN DIAGNOSTIC AND THERAPEUTIC required for viral replication or life cycle progression. Essential viral functions often are provided in trans in order to produce the mature virions for infection (see e.g., U.S. Pat. Nos. 5,750,396, 6,261,551, 6,924,128, 6,974,695). Thus, packaging cell lines that express the essential viral proteins are required for viral propagation. Such cell lines, however, can be challenging to generate due to the toxicity of the viral proteins that are expressed.

Mutation of non-essential genes is a method of attenuation that preserves the ability of the virus to propagate without the need of a packaging cell lines. In viruses such as vaccinia virus, mutations in non-essential genes, such as the thymidine kinase (TK) gene or hemagglutinin (HA) gene have been employed to attenuate the virus (e.g., Buller et al. (1985) Nature 317, 813-815, Shida et al. (1988) J. Virol. 62(12): 4474-80, Taylor et al. (1991) J. Gen. Virol. 72 (Pt 1): 125-30, U.S. Pat. Nos. 5,364,773, 6,265,189, 7,045,313). The inactivation of these genes decreases the overall pathogenicity of the virus without eliminating the ability of the viruses to replicate in certain cell types. Further modulation of the attenuation of the virus similarly is difficult, since it can require identification of additional non-essential genes for modification, followed by testing of combinations of mutations in order to select a recombinant virus with a desired level of attenuation.

In view of the efforts to generate attenuated viruses for therapy, including the methods mentioned above, there still exists a need for attenuated viruses. Accordingly, it is among the objects herein, to provide attenuated viruses that can be employed for diagnostic and/or therapeutic methods.

SUMMARY

Provided herein are therapeutic viruses. The viruses can be used as therapeutics. In addition they can be employed as starting materials in the methods for modulating attenuation. The therapeutic viruses can contain a heterologous nucleic acid, inserted for its encoded protein or for attenuation. The heterologous nucleic acid can contain an open reading frame operably linked to a promoter. The heterologous nucleic acid can be operatively linked to a native promoter or a heterologous (with respect to the virus) promoter. Any suitable promoters, including synthetic and naturally-occurring and modified promoters, can be used. Exemplary promoters include synthetic promoters, including synthetic viral and animal promoters. Native promoter or heterologous promoters include, but are not limited to, viral promoters, such as vaccinia virus and adenovirus promoters. Vaccinia viral promoters can be synthetic or natural promoters, and include vaccinia early, intermediate, early/late and late promoters. Exemplary vaccinia viral promoters for use in the methods provided herein can include, but are not limited to, $P_{7.5k}$, $P_{11k}$, $P_{SE}$, $P_{SEL}$, $P_{SL}$, H5R, TK, P28, C11R, G8R, F17R, I3L, I8R, A1L, A2L, A3L, H1L, H3L, H5L, H6R, H8R, D1R, D4R, D5R, D9R, D11L, D12L, D1 3L, M1L, N2L, P4b or K1 promoters. Other viral promoters can include, but are not limited to, adenovirus late promoter, Cowpox ATI promoter, or T7 promoter.

Provided herein are viruses for use as therapeutics and/or in diagnostic methods. Exemplary viruses provided herein include recombinant vaccinia viruses that contain a modified hemagglutinin (HA) gene, thymidine kinase (TK) gene, and F14.5L gene, where one or more of the modifications comprises insertion of a heterologous non-coding nucleic acid molecule into the HA gene locus, TK gene locus, or F14.5L gene locus. In such viruses, a functional HA, TK, and F14.5L polypeptide is not expressed. Exemplary viruses provided herein for therapeutic and diagnostic use include Lister strain vaccinia viruses, such as GLV-1i69, GLV-1h70, GLV-1h71, GLV-1h72, GLV-1h73, GLV-1h74, GLV-1h81, GLV-1h82, GLV-1h83, GLV-1h84, GLV-1h85, GLV-1h86, GLV-1j87, GLV-1j88, GLV-1j89, GLV-1h90, GLV-1h91, GLV-1h92, GLV-1h96, GLV-1h97, GLV-1h98, GLV-1h104, GLV-1h105, GLV-1h106, GLV-1h107, GLV-1h108 an GLV-1h109.

Viruses provided herein for therapeutic and diagnostic use include recombinant vaccinia viruses that contain a heterologous nucleic acid molecule that encodes a therapeutic gene product, such as an angiogenesis inhibitor (e.g., plasminogen kringle 5 domain, anti-vascular endothelial growth factor (VEGF) scAb (G6), tTF-RGD, truncated human tissue factor-Arginine-Glycine-Aspartic acid (RGD) peptide fusion protein), a tumor growth suppressor (e.g., IL-24), an immune stimulator (e.g., sIL-6R-IL-6, soluble IL-6 receptor-IL-6 fusion protein).

Such therapeutic gene products can be operably linked to a vaccinia promoter, such as a vaccinia early promoter, a vaccinia intermediate promoter, a vaccinia early/late promoter and a vaccinia late promoter.

Provided herein is an exemplary vaccinia virus that expresses the human plasminogen kringle 5 domain under the control of a vaccinia synthetic early/late promoter (GLV-1h81). Also provided herein are exemplary vaccinia viruses that express sIL-6R-IL-6 under the control of a vaccinia early promoter, vaccinia early/late promoter or vaccinia late promoter (GLV-1h90, GLV-1h91, and GLV-1h92, respectively). Also provided herein are exemplary vaccinia viruses that express IL-24 under the control of a vaccinia early promoter, vaccinia early/late promoter or vaccinia late promoter (GLV-1h96, GLV-1h97, and GLV-1h98, respectively). Also provided herein are exemplary vaccinia viruses that express a tTF-RGD fusion protein under the control of a vaccinia early promoter, vaccinia early/late promoter or vaccinia late promoter (GLV-1h104, GLV-1h105, and GLV-1h106, respectively). Also provided herein are exemplary vaccinia viruses that express an anti-VEGF scAb (G6)-FLAG fusion protein under the control of a vaccinia early promoter, vaccinia early/late promoter or vaccinia late promoter (GLV-1h107, GLV-1h108 and GLV-1h109, respectively).

Viruses provided herein for therapeutic and diagnostic use include recombinant vaccinia viruses that contain a heterologous nucleic acid molecule that encodes a detectable protein or a protein capable of inducing a detectable signal. Exemplary of such proteins are luciferases, such as a click beetle luciferase, a *Renilla* luciferase, or a firefly luciferase, fluorescent proteins, such as a GFP or RFP, or proteins that can bind a contrasting agent, chromophore, or a compound or ligand that can be detected, such as a transferrin receptor or a ferritin. Provided herein are recombinant Lister strain vaccinia viruses that express click beetle luciferase (e.g., click beetle green 99 luciferase, CBG99) and RFP (e.g., GLV-1h84).

Provided herein are viruses for therapeutic and diagnostic use that contain a heterologous nucleic acid molecule that encodes two or more diagnostic or therapeutic gene products, where the gene products are linked by a picornavirus 2A element. In one example provided herein, the recombinant vaccinia virus contains a heterologous nucleic acid molecule that encodes CBG99 linked by a picornavirus 2A element to a second heterologous nucleic acid molecule that encodes RFP (e.g., GLV-1h84).

Provided herein are recombinant vaccinia viruses for therapeutic and diagnostic use that contain a replacement of the A34R gene with the A34R gene from another vaccinia virus strain. Provided herein is a Lister strain vaccinia virus, where the A34R gene is replaced by the A34R gene from vaccinia IHD-J strain (e.g., GLV-1i69). Such replacement increases the extracellular enveloped virus (EEV) form of vaccinia virus and increases the resistance of the virus to neutralizing antibodies.

Provided herein are recombinant vaccinia viruses for therapeutic and diagnostic use that contain deletion of the A35R gene (e.g., GLV-1j87, GLV-1j88 GLV-1j89).

Provided herein are recombinant vaccinia viruses for therapeutic and diagnostic use that can be further modified by addition of one or more additional heterologous nucleic acid molecules that encode a therapeutic protein, a detectable protein or a protein capable of inducing a detectable signal. Exemplary of such proteins are luciferases, such as a click beetle luciferase, a *Renilla* luciferase, or a firefly luciferase, fluorescent proteins, such as a GFP or RFP, or proteins that can bind a contrasting agent, chromophore, or a compound or ligand that can be detected, such as a transferrin receptor or a ferritin. Also included in such methods are insertion of heterologous nucleic acid molecules that encode a therapeutic gene product, such as a cytokine, a chemokine, an immunomodulatory molecule, a single chain antibody, antisense RNA, siRNA, prodrug converting enzyme, a toxin, an antitumor oligopeptide, an anti-cancer polypeptide antibiotic, angiogenesis inhibitor, or tissue factor. Exemplary antigens include tumor specific antigens, tumor-associated antigens, tissue-specific antigens, bacterial antigens, viral antigens, yeast antigens, fungal antigens, protozoan antigens, parasite antigens and mitogens. The one or more additional heterologous nucleic acid molecules that encode a therapeutic protein, a detectable protein or a protein capable of inducing a detectable signal can be operatively linked to a promoter, such as a vaccinia virus promoter.

Provided herein are host cells that contains a recombinant virus provided herein. An exemplary host cell is a tumor cell that contains a recombinant virus provided herein.

Provided herein are pharmaceutical compositions that contain a recombinant virus provided herein and a pharmaceutically acceptable carrier. The compositions contain an amount or concentration of the virus suitable for the intended use, such as therapy, diagnostics or both, and route of administration. Provided herein are pharmaceutical compositions formulated for local or systemic administration. Provided herein are pharmaceutical compositions that contain two or more viruses. Provided herein are pharmaceutical compositions that are formulated for administration as a vaccine, such a smallpox vaccine.

Provided herein are methods of detecting one or more viruses in a subject involving the steps of: a) administering a pharmaceutical composition provided herein to a subject, where the pharmaceutical composition contains a virus provided herein that expresses a detectable protein or a protein capable of inducing a detectable signal, and b) detecting the detectable protein or a protein capable of inducing a detectable signal, whereby detection indicates the presence of the virus in the subject. Further, provided herein are methods of detecting a tumor in a subject involving the steps of: a) administering a pharmaceutical composition provided herein to a subject, where the pharmaceutical composition contains a virus provided herein that expresses a detectable protein or a protein capable of inducing a detectable signal, and b) detecting the detectable protein or a protein capable of inducing a detectable signal, whereby detection indicates the presence of a tumor in the subject. Methods provided herein for detection include, but are not limited to, fluorescence imaging, magnetic resonance imaging (MRI), single-photon emission computed tomography (SPECT), positron emission tomography (PET), scintigraphy, gamma camera, a $\beta+$ detector, a $\gamma$ detector, or a combination thereof. In some examples, two or more two or more detectable proteins or proteins capable of inducing a detectable signal are detected. For example, two or more fluorescent or luminescent proteins can be detected sequentially or simultaneously at different wavelengths.

Provided herein are methods of treatment of a tumor, cancer or metastasis by administering a pharmaceutical composition provided herein to a subject, such as a human subject or an animal subject. For the methods provided herein, administering the pharmaceutical composition causes tumor growth to stop or be delayed, causes a reduction in tumor volume or causes the tumor to be eliminated from the subject.

Exemplary tumors in humans for methods of treatment provided herein include, but are not limited to, bladder tumor, breast tumor, prostate tumor, carcinoma, basal cell carcinoma, biliary tract cancer, bladder cancer, bone cancer, brain cancer, CNS cancer, glioma tumor, cervical cancer, choriocarcinoma, colon and rectum cancer, connective tissue cancer, cancer of the digestive system, endometrial cancer, esophageal cancer, eye cancer, cancer of the head and neck, gastric cancer, intra-epithelial neoplasm, kidney cancer, larynx cancer, leukemia, liver cancer, lung cancer, lymphoma, Hodgkin's lymphoma, Non-Hodgkin's lymphoma, melanoma, myeloma, neuroblastoma, oral cavity cancer, ovarian cancer, pancreatic cancer, retinoblastoma, rhabdomyosarcoma, rectal cancer, renal cancer, cancer of the respiratory system, sarcoma, skin cancer, stomach cancer, testicular cancer, thyroid cancer, uterine cancer, and cancer of the urinary system. Exemplary tumors in a canine, feline, or pet subject for methods of treatment provided herein include, but are not limited to, lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma, granulocytic sarcoma, corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma, cystadenoma, follicular lymphoma, intestinal lymphosarcoma, fibrosarcoma, and pulmonary squamous cell carcinoma. Exemplary tumors in a rodent subject for methods of treatment provided herein include, but are not limited to, insulinoma, lymphoma, sarcoma, neuroma, pancreatic islet cell tumor, gastric MALT lymphoma and gastric adenocarcinoma. Exemplary tumors in an ovine, equine, bovine, caprine, avian, porcine, or piscine subject for methods of treatment provided herein include, but are not limited to, leukemia, hemangiopericytoma, ocular neoplasia, preputial fibrosarcoma, ulcerative squamous cell carcinoma, preputial carcinoma, connective tissue neoplasia, mastocytoma, hepatocellular carcinoma, lymphoma, pulmonary adenomatosis, pulmonary sarcoma, Rous sarcoma, reticuloendotheliosis, fibrosarcoma, nephroblastoma, B-cell lymphoma, lymphoid leukosis, retinoblastoma, hepatic neoplasia, lymphosarcoma, plasmacytoid leukemia, swimbladder sarcoma (in fish), caseous lumphadenitis, and lung tumor.

For the methods provided herein for a therapeutic or diagnostic application, a pharmaceutical composition provided herein can be administered systemically, intravenously, intraarterially, intratumorally, endoscopically, intralesionally, intramuscularly, intradermally, intraperitoneally, intravesicularly, intraarticularly, intrapleurally, percutaneously, subcutaneously, orally, parenterally, intranasally, intratracheally, by inhalation, intracranially, intraprostaticaly, intravitreally, topically, ocularly, vaginally, or rectally.

For the methods provided herein for treatment of a tumor, cancer or metastasis, the pharmaceutical composition provided herein can be administered with an anti-viral agent, such as, but not limited to, cidofovir, alkoxyalkyl esters of cidofovir, Gleevec, gancyclovir, acyclovir and ST-246.

Provided herein are combinations that contain a pharmaceutical composition provided herein and an anticancer agent. Exemplary anticancer agents for use in combinations provided herein include, but are not limited to, a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, hyperthermia or hyperthermia therapy, a bacterium, radiation therapy or a combination thereof. Exemplary chemotherapeutic compounds for use in combinations provided herein include, but are not limited to, alkylating agents such as a platinum coordination complex, among other chemotherapeutic compounds provided herein. Exemplary platinum coordination complexes include, but are not limited to, cisplatin, carboplatin, oxaliplatin, DWA2114R, NK121, IS 3 295, and 254-S.

Provided herein are combinations of the viruses provided and an anti cancer agent, such as a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, hyperthermia or hyperthermia therapy or a bacterium. Provided herein are combinations of the viruses provided and an anti cancer agent, such as cisplatin, carboplatin, gemcitabine, irinotecan, an anti-EGFR antibody and an anti-VEGF antibody.

Provided herein are combinations where the compound and virus are formulated separately in two compositions. Provided herein are combinations where the compound and virus are formulated as a single composition.

Provided herein are kits that contain a pharmaceutical composition or combination provided herein and optionally instructions for administration thereof for treatment of cancer.

Provided herein are vaccines, such as a smallpox vaccine, containing a recombinant vaccinia virus provided herein. Further, provided herein are methods of vaccination where a vaccine, such as a smallpox vaccine, containing a recombinant vaccinia virus provided herein is administered to a subject for generation of an immune response.

DETAILED DESCRIPTION

Outline

A. Definitions
B. Viruses for treatment and diagnosis
 1. Viruses with altered infectivity
  a. Viruses with modified viral proteins
   i. Increase in the Vaccinia EEV form by replacement of A34R
   ii. Deletion of A35R
  b. Viruses with multiple genome insertions and/or deletions
 2. Viruses that express proteins for tumor imaging
 3. Viruses that express proteins for tumor treatment
  a. Proteins for inhibiting angiogenesis
   i. hk5
   ii. tTF-RGD
   iii. anti-VEGF scab
  b. Proteins for tumor growth suppression
   i. sIL-6R-IL-6
   ii. IL-24
 4. Viruses that express proteins for combined tumor diagnosis and treatment
C. Further modifications of viruses provided
 1. Modification of viral genes
 2. Expression of additional heterologous genes
  a. Detectable gene product
  b. Therapeutic gene product
  c. Superantigen
  d. Gene product to be harvested
  e. Control of heterologous gene expression
D. Methods for making a modified virus
 1. Genetic modifications
 2. Screening of modified viruses
E. Exemplary characteristics of the viruses provided
 1. Attenuated
  a. Reduced toxicity
  b. Accumulate in tumor, not substantially in other organs
  c. Ability to elicit or enhance immune response to tumor cells
  d. Balance of pathogenicity and release of tumor antigens
 2. Immunogenicity
 3. Replication competent
 4. Genetic variants
F. Pharmaceutical Compositions, combinations and kits
 1. Pharmaceutical compositions
 2. Host cells
 3. Combinations
 4. Kits
G. Therapeutic Methods
 1. Administration
  a. Steps prior to administering the virus
  b. Mode of administration
  c. Dosages
  d. Number of administrations
  e. Co-administrations
   i. Administering a plurality of viruses
   ii. Therapeutic Compounds
   iii. Immunotherapies and biological therapies
  f. State of subject
 2. Monitoring
  a. Monitoring viral gene expression
  b. Monitoring tumor size
  c. Monitoring antibody titer
  d. Monitoring general health diagnostics
  e. Monitoring coordinated with treatment
H. Methods of producing gene products and antibodies
 1. Production of recombinant proteins and RNA molecules
 2. Production of antibodies
I. Examples

A. DEFINITIONS

Unless defined otherwise, all technical and scientific terms used herein have the same meaning as is commonly understood by one of skill in the art to which the invention(s)

belong. All patents, patent applications, published applications and publications, websites and other published materials referred to throughout the entire disclosure herein, unless noted otherwise, are incorporated by reference in their entirety. In the event that there are pluralities of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, "virus" refers to any of a large group of entities referred to as viruses. Viruses typically contain a protein coat surrounding an RNA or DNA core of genetic material, but no semipermeable membrane, and are capable of growth and multiplication only in living cells. Viruses for use in the methods provided herein include, but are not limited to, a poxvirus, adenovirus, herpes simplex virus, Newcastle disease virus, vesicular stomatitis virus, mumps virus, influenza virus, measles virus, reovirus, human immunodeficiency virus (HIV), hanta virus, myxoma virus, cytomegalovirus (CMV), lentivirus, and any plant or insect virus.

As used herein, the term "viral vector" is used according to its art-recognized meaning. It refers to a nucleic acid vector construct that includes at least one element of viral origin and can be packaged into a viral vector particle. The viral vector particles can be used for the purpose of transferring DNA, RNA or other nucleic acids into cells either in vitro or in vivo. Viral vectors include, but are not limited to, retroviral vectors, vaccinia vectors, lentiviral vectors, herpes virus vectors (e.g., HSV), baculoviral vectors, cytomegalovirus (CMV) vectors, papillomavirus vectors, simian virus (SV40) vectors, semliki forest virus vectors, phage vectors, adenoviral vectors, and adeno-associated viral (AAV) vectors.

As used herein, the term "modified" with reference to a gene refers to a deleted gene, a gene encoding a gene product having one or more truncations, mutations, insertions or deletions, or a gene that is inserted (into the chromosome or on a plasmid, phagemid, cosmid, and phage) encoding a gene product, typically accompanied by at least a change in function of the modified gene product or virus.

As used herein, the term "modified virus" refers to a virus that is altered with respect to a parental strain of the virus. Typically modified viruses have one or more truncations, mutations, insertions or deletions in the genome of virus. A modified virus can have one or more endogenous viral genes modified and/or one or more intergenic regions modified. Exemplary modified viruses can have one or more heterologous nucleic acid sequences inserted into the genome of the virus. Modified viruses can contain one more heterologous nucleic acid sequences in the form of a gene expression cassette for the expression of a heterologous gene.

As used herein, modification of a heterologous nucleic acid molecule with respect to a virus containing a heterologous nucleic acid molecule refers to any alteration of the heterologous nucleic acid molecule including truncations, mutations, insertions or deletions of the nucleic acid molecule. A deletion in a heterologous nucleic acid molecule can include all or a portion of the heterologous nucleic acid molecule. For example, if the heterologous nucleic acid molecule is a double stranded DNA molecule that is 5,000 base pairs in length, deletions of the heterologous nucleic acid molecule can include deletions of 1, 2, 3, 4, 5 or more, 10 or more, 50 or more, 100 or more, 500 or more, 1,000 or more, or 5,000 base pairs of the heterologous nucleic acid molecule. Deletion of all or a part of the nucleic acid molecule can also include replacement of the heterologous nucleic acid molecule with another nucleic acid molecule. Modification of a heterologous nucleic acid molecule can also include alteration of the viral genome. For example, a deletion of all or a portion of heterologous nucleic acid from the viral genome, for example by homologous recombination, may also include deletion of nucleic acid surrounding the deletion site that is part of the viral genome. Similarly, insertion of an additional heterologous nucleic acid molecule into the viral genome by homologous recombination, for example, may include deletion or all, or a part of a viral gene. When modification of a heterologous nucleic acid molecule is an insertion, an additional nucleic acid molecule can be inserted in the heterologous nucleic acid molecule or adjacent to the nucleic acid molecule. Typically, insertions by homologous recombination involve replacement of all or a part of the heterologous nucleic acid molecule with another nucleic acid molecule.

As used herein, the term "therapeutic virus" refers to a virus that is administered for the treatment of a disease or disorder, such as cancer, a tumor and/or a metastasis or inflammation or wound or diagnosis thereof and or both. A therapeutic virus typically is modified, such as to attenuate it. Other modifications include one or more insertions, deletions or mutations in the genome of the virus. Therapeutic viruses all can include modifications in one or more endogenous viral genes or one or more intergenic regions, which attenuate the toxicity of the virus, and can optionally express a heterologous therapeutic gene product and/or detectable protein. Therapeutic viruses can contain heterologous nucleic acid molecules, including one or more gene expression cassettes for the expression of the therapeutic gene product and/or detectable protein. Therapeutic viruses can be replication competent viruses (e.g., oncolytic viruses) or replication-defective viruses.

As used herein, a virus that can be detected and used for diagnostics and is therapeutic is a theragnostic virus.

As used herein, the term, "therapeutic gene product" or "therapeutic polypeptide" refers to any heterologous protein expressed by the therapeutic virus that ameliorates the symptoms of a disease or disorder or ameliorates the disease or disorder.

As used herein, the phrase "immunoprivileged cells and tissues" refers to cells and tissues, such as solid tumors and wounded tissues, which are sequestered from the immune system.

As used herein, preferential accumulation refers to accumulation of a virus at a first location at a higher level than accumulation at a second location. Thus, a virus that preferentially accumulates in immunoprivileged tissue, such as a tumor, relative to normal tissues or organs refers to a virus that accumulates in immunoprivileged tissue, such as tumor, at a higher level, or concentration, than the virus accumulates in normal tissues or organs.

As used herein, to attenuate toxicity of a virus means to reduce or eliminate deleterious or toxic effects to a host upon administration of the virus compared to an un-attenuated virus. As used herein, a virus with low toxicity means that upon administration a virus does not accumulate in organs and tissues in the host to an extent that results in damage or harm to organs, or that impacts survival of the host to a greater extent than the disease being treated does. For the purposes herein, attenuation of toxicity is used interchangeably with attenuation of virulence and attenuation of pathogenicity.

As used herein, the term "toxicity" with reference to a virus refers to the ability of the virus to cause harm to the subject to which the virus has been administered.

As used herein virulence and pathogenicity with reference to a virus refers to the ability of the virus to cause disease or harm in the subject to which the virus has been administered. Hence, for the purposes herein the terms toxicity, virulence and pathogenicity with reference to a virus are used interchangeably.

As used herein, a compound produced in a tumor or other immunoprivileged site refers to any compound that is produced in the tumor or tumor environment by virtue of the presence of an introduced virus, generally a recombinant virus, expressing one or more gene products. For example, a compound produced in a tumor can be, for example, an encoded polypeptide, such as a recombinant polypeptide (e.g., a cell-surface receptor, a cytokine, a chemokine, an apoptotic protein, a mitosis inhibitor protein, an antimitotic oligopeptide, a toxin, a tumor antigen, a prodrug converting enzyme), an RNA (e.g., ribozyme, RNAi, siRNA), or a compound that is generated by an encoded polypeptide and, in some examples, the cellular machinery of the tumor or immunoprivileged tissue or cells (e.g., a metabolite, a converted prodrug).

As used herein, a delivery vehicle for administration refers to a lipid-based or other polymer-based composition, such as liposome, micelle or reverse micelle, which associates with an agent, such as a virus provided herein, for delivery into a host animal.

As used herein, a disease or disorder refers to a pathological condition in an organism resulting from, for example, infection or genetic defect, and characterized by identifiable symptoms.

As used herein, treatment means any manner in which the symptoms of a condition, disorder or disease are ameliorated or otherwise beneficially altered. Treatment also encompasses any pharmaceutical use of the viruses described and provided herein.

As used herein, amelioration or alleviation of the symptoms of a particular disorder, such as by administration of a particular pharmaceutical composition, refers to any lessening, whether permanent or temporary, lasting or transient that can be attributed to or associated with administration of the composition.

As used herein, an effective amount of a virus or compound for treating a particular disease is an amount that is sufficient to ameliorate, or in some manner reduce the symptoms associated with the disease. Such an amount can be administered as a single dosage or can be administered according to a regimen, whereby it is effective. The amount can cure the disease but, typically, is administered in order to ameliorate the symptoms of the disease. Repeated administration can be required to achieve the desired amelioration of symptoms.

As used herein, an in vivo method refers to a method performed within the living body of a subject.

As used herein, a subject includes any animal for whom diagnosis, screening, monitoring or treatment is contemplated. Animals include mammals such as primates and domesticated animals. An exemplary primate is human. A patient refers to a subject such as a mammal, primate, human, or livestock subject afflicted with a disease condition or for which a disease condition is to be determined or risk of a disease condition is to be determined.

As used herein, the term "neoplasm" or "neoplasia" refers to abnormal new cell growth, and thus means the same as tumor, which can be benign or malignant. Unlike hyperplasia, neoplastic proliferation persists even in the absence of the original stimulus.

As used herein, neoplastic disease refers to any disorder involving cancer, including tumor development, growth, metastasis and progression.

As used herein, cancer is a term for diseases caused by or characterized by any type of malignant tumor, including metastatic cancers, lymphatic tumors, and blood cancers. Exemplary cancers include, but are not limited to: leukemia, lymphoma, pancreatic cancer, lung cancer, ovarian cancer, breast cancer, cervical cancer, bladder cancer, prostate cancer, glioma tumors, adenocarcinomas, liver cancer and skin cancer. Exemplary cancers in humans include a bladder tumor, breast tumor, prostate tumor, basal cell carcinoma, biliary tract cancer, bladder cancer, bone cancer, brain and CNS cancer (e.g., glioma tumor), cervical cancer, choriocarcinoma, colon and rectum cancer, connective tissue cancer, cancer of the digestive system; endometrial cancer, esophageal cancer; eye cancer; cancer of the head and neck; gastric cancer; intra-epithelial neoplasm; kidney cancer; larynx cancer; leukemia; liver cancer; lung cancer (e.g. small cell and non-small cell); lymphoma including Hodgkin's and Non-Hodgkin's lymphoma; melanoma; myeloma, neuroblastoma, oral cavity cancer (e.g., lip, tongue, mouth, and pharynx); ovarian cancer; pancreatic cancer, retinoblastoma; rhabdomyosarcoma; rectal cancer, renal cancer, cancer of the respiratory system; sarcoma, skin cancer; stomach cancer, testicular cancer, thyroid cancer; uterine cancer, cancer of the urinary system, as well as other carcinomas and sarcomas. Malignant disorders commonly diagnosed in dogs, cats, and other pets include, but are not limited to, lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma (e.g., granulocytic sarcoma), corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma and cystadenoma, follicular lymphoma, intestinal lymphosarcoma, fibrosarcoma and pulmonary squamous cell carcinoma. In rodents, such as a ferret, exemplary cancers include insulinoma, lymphoma, sarcoma, neuroma, pancreatic islet cell tumor, gastric MALT lymphoma and gastric adenocarcinoma. Neoplasias affecting agricultural livestock include leukemia, hemangiopericytoma and bovine ocular neoplasia (in cattle); preputial fibrosarcoma, ulcerative squamous cell carcinoma, preputial carcinoma, connective tissue neoplasia and mastocytoma (in horses); hepatocellular carcinoma (in swine); lymphoma and pulmonary adenomatosis (in sheep); pulmonary sarcoma, lymphoma, Rous sarcoma, reticulo-endotheliosis, fibrosarcoma, nephroblastoma, B-cell lymphoma and lymphoid leukosis (in avian species); retinoblastoma, hepatic neoplasia, lymphosarcoma (lymphoblastic lymphoma), plasmacytoid leukemia and swimbladder sarcoma (in fish), caseous lumphadenitis (CLA): chronic, infectious, contagious disease of sheep and goats caused by the bacterium *Corynebacterium pseudotuberculosis*, and contagious lung tumor of sheep caused by jaagsiekte.

As used herein, the term "malignant," as it applies to tumors, refers to primary tumors that have the capacity of metastasis with loss of growth control and positional control.

As used herein, metastasis refers to a growth of abnormal or neoplastic cells distant from the site primarily involved by the morbid process.

As used herein, proliferative disorders include any disorders involving abnormal proliferation of cells, such as, but not limited to, neoplastic diseases.

As used herein, a method for treating or preventing neoplastic disease means that any of the symptoms, such as the tumor, metastasis thereof, the vascularization of the tumors or other parameters by which the disease is characterized are reduced, ameliorated, prevented, placed in a state of remission, or maintained in a state of remission. It also means that the indications of neoplastic disease and metastasis can be eliminated, reduced or prevented by the treatment. Non-limiting examples of the indications include uncontrolled degradation of the basement membrane and proximal extracellular matrix, migration, division, and organization of the endothelial cells into new functioning capillaries, and the persistence of such functioning capillaries.

As used herein, the term "angiogenesis" is intended to encompass the totality of processes directly or indirectly involved in the establishment and maintenance of new vasculature (neovascularization), including, but not limited to, neovascularization associated with tumors and neovascularization associated with wounds.

As used herein, therapeutic agents are agents that ameliorate the symptoms of a disease or disorder or ameliorate the disease or disorder. Therapeutic agent, therapeutic compound, therapeutic regimen, or chemotherapeutic include conventional drugs and drug therapies, including vaccines, which are known to those skilled in the art and described elsewhere herein. Therapeutic agents include, but are not limited to, moieties that inhibit cell growth or promote cell death, that can be activated to inhibit cell growth or promote cell death, or that activate another agent to inhibit cell growth or promote cell death. Optionally, the therapeutic agent can exhibit or manifest additional properties, such as, properties that permit its use as an imaging agent, as described elsewhere herein. Therapeutic agents for the compositions, methods and uses provided herein can be, for example, an anti-cancer agent. Exemplary therapeutic agents include, for example, cytokines, growth factors, photosensitizing agents, radionuclides, toxins, anti-metabolites, signaling modulators, anti-cancer antibiotics, anti-cancer antibodies, angiogenesis inhibitors, radiation therapy, chemotherapeutic compounds or a combination thereof.

As used herein, anti-cancer agents (used interchangeably with "anti-tumor or anti-neoplastic" agent) include any anti-cancer therapies, such as radiation therapy, surgery, hyperthermia or hyperthermia therapy, or anti-cancer compounds useful in the treatment of cancer. These include any agents, when used alone or in combination with other agent, that can alleviate, reduce, ameliorate, prevent, or place or maintain in a state of remission of clinical symptoms or diagnostic markers associated with neoplastic disease, tumors and cancer, and can be used in methods, combinations and compositions provided herein. Exemplary anti-cancer agents include, but are not limited to, the viruses provided herein used singly or in combination and/or in combination with other anti-cancer agents. Exemplary anti-cancer compounds include cytokines, chemokines, growth factors, photosensitizing agents, toxins, anti-cancer antibiotics, chemotherapeutic compounds, radionuclides, angiogenesis inhibitors, signaling modulators, anti-metabolites, anti-cancer vaccines, anti-cancer oligopeptides, mitosis inhibitor proteins, antimitotic oligopeptides, anti-cancer antibodies, anti-cancer antibiotics, immunotherapeutic agents, bacteria and any combinations thereof.

Exemplary cytokines and growth factors include, but are not limited to, interleukins, such as, for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factors (GM-CSF), angiogenins, and tissue factors.

Photosensitizing agents include, but are not limited to, for example, indocyanine green, toluidine blue, aminolevulinic acid, texaphyrins, benzoporphyrins, phenothiazines, phthalocyanines, porphyrins such as sodium porfimer, chlorins such as tetra(m-hydroxyphenyl)chlorin or tin(IV) chlorin e6, purpurins such as tin ethyl etiopurpurin, purpurinimides, bacteriochlorins, pheophorbides, pyropheophorbides or cationic dyes.

Radionuclides, which depending upon the radionuclide, amount and application can be used for diagnosis and/or for treatment. They include, but are not limited to, for example, a compound or molecule containing $^{11}$Carbon, $^{11}$Fluorine, $^{13}$Carbon, $^{15}$Nitrogen, $^{18}$Fluorine, $^{19}$Fluorine, $^{32}$Phosphate, $^{60}$Cobalt, $^{90}$Yttirum, $^{99}$Technetium, $^{103}$Palladium, $^{106}$Ruthenium, $^{111}$Indium, $^{117}$lutetium, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth or $^{213}$Bismuth.

Toxins include, but are not limited to, chemotherapeutic compounds such as, but not limited to, 5-fluorouridine, calicheamicin and maytansine.

Anti-metabolites include, but are not limited to, methotrexate, 5-fluorouracil, 6-mercaptopurine, cytosine arabinoside, hydroxyurea and 20-chlorodeoxyadenosine.

Signaling modulators include, but are not limited to, for example, inhibitors of macrophage inhibitory factor, toll-like receptor agonists and stat 3 inhibitors.

Anti-cancer antibiotics include, but are not limited to, anthracyclines such as doxorubicin hydrochloride (adriamycin), idarubicin hydrochloride, daunorubicin hydrochloride, aclarubicin Hydrochloride, epirubicin hydrochloride and purarubicin hydrochloride, enomycin, phenomycin, pleomycins such as pleomycin and peplomycin sulfate, mitomycins such as mitomycin C, actinomycins such as actinomycin D, zinostatinstimalamer and polypeptides such as neocarzinostatin.

Anti-cancer antibodies include, but are not limited to, Rituximab, ADEPT, Trastuzumab (Herceptin), Tositumomab (Bexxar), Cetuximab (Erbitux), Ibritumomab (Zevalin), Alemtuzumab (Campath-1H), Epratuzumab (Lymphocide), Gemtuzumab ozogamicin (Mylotarg), Bevacizumab (Avastin), Tarceva (Erlotinib), SUTENT (sunitinib malate), Panorexo (Edrecolomab), RITUXAN (Rituximab), Zevalin (90Y-ibritumomab tiuexetan), Mylotarg (Gemtuzumab Ozogamicin) and Campath (Alemtuzumab).

Angiogenesis inhibitors include, but are not limited to, collagenase inhibitors such as metalloproteinases and tetracyclines such as minocycline, naturally occurring peptides such as endostatin and angiostatin, fungal and bacterial derivatives, such as fumagillin derivatives like TNP-470, aptamer antagonist of VEGF, batimastat, Captopril, cartilage derived inhibitor (CDI), genistein, interleukin 12, Lavendustin A, medroxyprogesterone acetate, recombinant human platelet factor 4(rPF4), taxol, D-gluco-D-galactan sulfate (Tecogalan(=SP-PG, DS-4152)), thalidomide, thrombospondin.

Radiation therapy includes, but is not limited to, photodynamic therapy, radionuclides, radioimmunotherapy and proton beam treatment.

Chemotherapeutic compounds include, but are not limited to platinum; platinum analogs (e.g., platinum coordination complexes) such as cisplatin, carboplatin, oxaliplatin, DWA2114R, NK121, IS 3 295, and 254-S; anthracenediones; vinblastine; alkylating agents such as thiotepa and cyclophosphamide; alkyl sulfonates such as busulfan, improsulfan and piposulfan; aziridines such as benzodopa, carboquone, meturedopa and uredopa; ethylenimines and methylamelamines including altretamine, triethylenemelamine, triethylenephosphoramide, triethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenishers such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; substituted ureas; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; anti-cancer polysaccharides; polysaccharide-K; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; cytosine arabinoside; cyclophosphamide; thiotepa; taxoids, such as paclitaxel and doxetaxel; chlorambucil; gemcitabine; 6-thioguanine; mercaptopurine; methotrexate; etoposide (VP-16); ifosfamide; mitomycin C; mitoxantrone; vincristine; vinorelbine; navelbine; novantrone; teniposide; daunomycin; aminopterin; xeloda; ibandronate; CPT11; topoisomerase inhibitor RFS 2000; difluoromethylornithine (DMFO); retinoic acid; esperamicins; capecitabine; methylhydrazine derivatives; Erlotinib (TARCEVA); sunitinib malate (SUTENT) and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (Fareston); adrenocortical suppressants; and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods.

As used herein, an anti-cancer oligopeptide or an anti-tumor oligopeptide is short polypeptide that has the ability to slow or inhibit tumor growth and/or metastasis. Anti-cancer oligopeptide typically have high affinity for and specificity to tumors enabling them to target tumors. Such oligopeptides include receptor-interacting compounds, inhibitors of protein-protein interactions, enzyme inhibitors, and nucleic acid-interacting compounds. As used herein an antimitotic oligopeptide is an oligopeptide that inhibits cell division. An antimitotic oligopeptide is an exemplary anti-cancer oligopeptide. Exemplary antimitotic oligopeptides include, but are not limited to, tubulysin, phomopsin, hemiasterlin, taltobulin (HTI-286, 3), and cryptophycin.

As used herein, a prodrug is a compound that, upon in vivo administration, is metabolized or otherwise converted to the biologically, pharmaceutically or therapeutically active form of the compound. To produce a prodrug, the pharmaceutically active compound is modified such that the active compound is regenerated by metabolic processes. The prodrug can be designed to alter the metabolic stability or the transport characteristics of a drug, to mask side effects or toxicity, to improve the flavor of a drug or to alter other characteristics or properties of a drug. By virtue of knowledge of pharmacodynamic processes and drug metabolism in vivo, those of skill in this art, once a pharmaceutically active compound is known, can design prodrugs of the compound (see, e.g., Nogrady (1985) *Medicinal Chemistry A Biochemical Approach*, Oxford University Press, New York, pages 388-392). Prodrugs include, but are not limited to, 5-fluorocytosine, gancyclovir, 6-methylpurine deoxyriboside, cephalosporin-doxorubicin, 4-[(2-chloroethyl)(2-mesyloxyethyl)amino] benzoyl-L-glutamic acid, indole-3-acetic acid, 7-ethyl-10-[4-(1-piperidino)-1-piperidino]carbonyloxycampotothecin, bis-(2-chloroethyl)amino-4-hydroxyphenylaminometha-none 28, 1-chloromethyl-5-hydroxy-1,2-dihydro-3H-benz [e]indole, epirubicin-glucoronide, 5'-deoxy-5-fluorouridine, cytosine arabinoside, and linamarin.

As used herein, a compound conjugated to a moiety refers to a complex that includes a compound bound to a moiety, where the binding between the compound and the moiety can arise from one or more covalent bonds or non-covalent interactions such as hydrogen bonds, or electrostatic interactions. A conjugate also can include a linker that connects the compound to the moiety. Exemplary compounds include, but are not limited to, nanoparticles and siderophores. Exemplary moieties, include, but are not limited to, detectable moieties and therapeutic agents.

As used herein, nanoparticle refers to a microscopic particle whose size is measured in nanometers. Often such particles in nanoscale are used in biomedical applications acting as drug carriers or imaging agents. Nanoparticles can be conjugated to other agents, including, but not limited to detectable/diagnostic agents or therapeutic agents.

As used herein, a detectable label or detectable moiety or diagnostic moiety (also imaging label, imaging agent, or imaging moiety) refers to an atom, molecule or composition, wherein the presence of the atom, molecule or composition can be directly or indirectly measured.

As used herein, a detectable moiety or an imaging moiety refer to moieties used to image a virus in any of the methods provided herein. Imaging (detectable) moieties include, for example, chemiluminescent moieties, bioluminescent moieties, fluorescent moieties, radionuclides and metals.

As used herein, a detection agent or an imaging agent refer to any molecule, compound, or polypeptide used to image a virus in any of the methods provided herein. Detection agents or imaging agents can contain, for example, a detectable moiety or can be a substrate, such as a luciferin, that produces a detectable signal following modification, such as by chemical modification by a luciferase.

As used herein, detect, detected and detecting refer generally to any manner of discovering or determining the presence of a signal, such as visual inspection, fluorescence spectroscopy, absorption, reflectance measurement, flow cytometry, magnetic resonance methods such as magnetic resonance imaging (MRI) and magnetic resonance spectroscopy (MRS), ultrasound, X-rays, gamma rays (after annihilation of a positron and an electron in PET scanning), tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. Direct detection of a detectable label refers to, for example, measurement of a physical phenomenon, such as energy or particle emission or absorption of the moiety itself, such as by X-ray or MRI. Indirect detection refers to measurement of a physical phenomenon, such as energy or particle emission or absorption, of an atom, molecule or composition that binds directly or indirectly to the detectable moiety. In a non-limiting example of indirect detection, a detectable label can be biotin, which can be detected by binding to avidin. Non-labeled avidin can be administered systemically to block non-specific binding, followed by systemic administration of labeled avidin. Thus, included within the scope of a detectable label or detectable moiety is a bindable label or bindable moiety, which refers to an atom, molecule or composition, wherein the presence of the atom, molecule or composition can be detected as a result of the label or moiety binding to another atom, molecule or composition. Exemplary diagnostic agents include, for example, metals such as colloidal gold, iron, gadolinium, and gallium-67, fluorescent moieties and radionuclides. Exemplary fluorescent moieties and radionuclides are provided elsewhere herein.

As used herein, magnetic resonance imaging (MRI) refers to the use of a nuclear magnetic resonance spectrometer to produce electronic images of specific atoms and molecular structures in solids, especially human cells, tissues and organs. MRI is non-invasive diagnostic technique that uses nuclear magnetic resonance to produce cross-sectional images of organs and other internal body structures. The subject lies inside a large, hollow cylinder containing a strong electromagnet, which causes the nuclei of certain atoms in the body (such as, for example, $^1H$, $^{13}C$ and $^{19}F$) to align magnetically. The subject is then subjected to radio waves, which cause the aligned nuclei to flip; when the radio waves are withdrawn the nuclei return to their original positions, emitting radio waves that are then detected by a receiver and translated into a two-dimensional picture by computer. For some MRI procedures, contrast agents such as gadolinium are used to increase the accuracy of the images.

As used herein, an X-ray refers to a relatively high-energy photon, or a stream of such photons, having a wavelength in the approximate range from 0.01 to 10 nanometers. X-rays also refer to photographs taken with x-rays.

As used herein, nucleic acids include DNA, RNA and analogs thereof, including peptide nucleic acids (PNA) and mixtures thereof. Nucleic acids can be single or double-stranded. Nucleic acids can encode for example gene products, such as, for example, polypeptides, regulatory RNAs, siRNAs and functional RNAs.

As used herein, primer refers to an oligonucleotide containing two or more deoxyribonucleotides or ribonucleotides, typically more than three, from which synthesis of a primer extension product can be initiated. Typically a primer contains a free 3' hydroxy moiety. Experimental conditions conducive to synthesis of a gene product include the presence of nucleoside triphosphates and an agent for polymerization and extension, such as DNA polymerase, and a suitable buffer, temperature, and pH. When referring to probes or primers, which are optionally labeled, such as with a detectable label, such as a fluorescent or radiolabel, single-stranded molecules are provided. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 5, 6, 7, 8, 9, 10 or more, 20 or more, 30 or more, 50 or more, 100 or more nucleic acids long.

As used herein, a sequence complementary to at least a portion of an RNA, with reference to antisense oligonucleotides, means a sequence of nucleotides having sufficient complementarity to be able to hybridize with the RNA, generally under moderate or high stringency conditions, forming a stable duplex; in the case of double-stranded antisense nucleic acids, a single strand of the duplex DNA (i.e., dsRNA) can thus be tested, or triplex formation can be assayed. The ability to hybridize depends on the degree of complementarity and the length of the antisense nucleic acid. Generally, the longer the hybridizing nucleic acid, the more base mismatches with an encoding RNA it can contain and still form a stable duplex (or triplex, as the case can be). One skilled in the art can ascertain a tolerable degree of mismatch by use of standard procedures to determine the melting point of the hybridized complex.

As used herein, a heterologous nucleic acid (also referred to as exogenous nucleic acid or foreign nucleic acid) refers to a nucleic acid that is not normally produced in vivo by an organism or virus from which it is expressed or that is produced by an organism or a virus but is at a different locus, expressed differently, or that mediates or encodes mediators that alter expression of endogenous nucleic acid, such as DNA, by affecting transcription, translation, or other regulatable biochemical processes. Heterologous nucleic acid is often not endogenous to a cell or virus into which it is introduced, but has been obtained from another cell or virus or prepared synthetically. Heterologous nucleic acid can refer to a nucleic acid molecule from another cell in the same organism or another organism, including the same species or another species. Heterologous nucleic acid, however, can be endogenous, but is nucleic acid that is expressed from a different locus or altered in its expression or sequence (e.g., a plasmid). Thus, heterologous nucleic acid includes a nucleic acid molecule not present in the exact orientation or position as the counterpart nucleic acid molecule, such as DNA, is found in a genome. Generally, although not necessarily, such nucleic acid encodes RNA and proteins that are not normally produced by the cell or virus or in the same way in the cell in which it is expressed. Any nucleic acid, such as DNA, that one of skill in the art recognizes or considers as heterologous, exogenous or foreign to the cell in which the nucleic acid is expressed is herein encompassed by heterologous nucleic acid.

As used herein, a heterologous protein or heterologous polypeptide (also referred to as exogenous protein, exogenous polypeptide, foreign protein or foreign polypeptide) refers to a protein that is not normally produced in vivo by an organism.

As used herein, operative linkage of heterologous nucleic acids to regulatory and effector sequences of nucleotides, such as promoters, enhancers, transcriptional and translational stop sites, and other signal sequences refers to the relationship between such nucleic acid, such as DNA, and such sequences of nucleotides. For example, operative linkage of heterologous DNA to a promoter refers to the physical relationship between the DNA and the promoter such that the transcription of such DNA is initiated from the promoter by an RNA polymerase that specifically recognizes, binds to and transcribes the DNA. Thus, operatively linked or operationally associated refers to the functional relationship of a nucleic acid, such as DNA, with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes, binds to and transcribes the DNA. In order to optimize expression and/or transcription, it can be necessary to remove, add or alter 5' untranslated portions of the clones to eliminate extra, potentially inappropriate, alternative translation initiation (i.e., start) codons or other sequences that can interfere with or reduce expression, either at the level of transcription or translation. In addition, consensus ribosome binding sites can be inserted immediately 5' of the start codon and can enhance expression (see, e.g., Kozak *J. Biol. Chem.* 266: 19867-19870 (1991); Shine and Delgarno *Nature* 254(5495): 34-38 (1975)). The desirability of (or need for) such modification can be empirically determined.

As used herein, a promoter, a promoter region or a promoter element or regulatory region or regulatory element refers to a segment of DNA or RNA that controls transcription of the DNA or RNA to which it is operatively linked. The promoter region includes specific sequences that are involved in RNA polymerase recognition, binding and transcription initiation. In addition, the promoter includes sequences that modulate recognition, binding and transcription initiation activity of RNA polymerase (i.e., binding of one or more transcription factors). These sequences can be cis acting or can be responsive to trans acting factors. Promoters, depending upon the nature of the regulation, can be constitutive or regulated. Regulated promoters can be inducible or environmentally responsive (e.g. respond to cues such as pH, anaerobic conditions, osmoticum, temperature, light, or cell density). Many such promoter sequences are known in the art. See, for example, U.S. Pat. Nos. 4,980,285; 5,631,150; 5,707, 928; 5,759,828; 5,888,783; 5,919,670, and, Sambrook, et al., Molecular Cloning: A Laboratory Manual, 2nd Ed., Cold Spring Harbor Press (1989).

As used herein, a native promoter is a promoter that is endogenous to the organism or virus and is unmodified with respect to its nucleotide sequence and its position in the viral genome as compared to a wild-type organism or virus.

As used herein, a heterologous promoter refers to a promoter that is not normally found in the wild-type organism or virus or that is at a different locus as compared to a wild-type organism or virus. A heterologous promoter is often not endogenous to a cell or virus into which it is introduced, but has been obtained from another cell or virus or prepared synthetically. A heterologous promoter can refer to a promoter from another cell in the same organism or another organism, including the same species or another species. A heterologous promoter, however, can be endogenous, but is a promoter that is altered in its sequence or occurs at a different locus (e.g., at a different location in the genome or on a plasmid). Thus, a heterologous promoter includes a promoter not present in the exact orientation or position as the counterpart promoter is found in a genome.

A synthetic promoter is a heterologous promoter that has a nucleotide sequence that is not found in nature. A synthetic promoter can be a nucleic acid molecule that has a synthetic sequence or a sequence derived from a native promoter or portion thereof. A synthetic promoter can also be a hybrid promoter composed of different elements derived from different native promoters.

As used herein a "gene expression cassette" or "expression cassette" is a nucleic acid construct, containing nucleic acid elements that are capable of effecting expression of a gene in hosts that are compatible with such sequences. Expression cassettes include at least promoters and optionally, transcription termination signals. Typically, the expression cassette includes a nucleic acid to be transcribed operably linked to a promoter. Additional factors helpful in effecting expression can also be used as described herein. Expression cassettes can contain genes that encode, for example, a therapeutic gene product or a detectable protein or a selectable marker gene.

As used herein, replacement of a promoter with a stronger promoter refers to removing a promoter from a genome and replacing it with a promoter that effects an increased the level of transcription initiation relative to the promoter that is replaced. Typically, a stronger promoter has an improved ability to bind polymerase complexes relative to the promoter that is replaced. As a result, an open reading frame that is operably linked to the stronger promoter has a higher level of gene expression. Similarly, replacement of a promoter with a weaker promoter refers to removing a promoter from a genome and replacing it with a promoter that decreases the level of transcription initiation relative to the promoter that is replaced. Typically, a weaker promoter has a lessened ability to bind polymerase complexes relative to the promoter that is replaced. As a result, an open reading frame that is operably linked to the weaker promoter has a lower level of gene expression.

As used herein, production by recombinant means by using recombinant DNA methods means the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Selection and use of such vectors are well known to those of skill in the art. An expression vector includes vectors capable of expressing DNA that is operatively linked with regulatory sequences, such as promoter regions, that are capable of effecting expression of such DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome. Vectors can be used in the generation of a recombinant genome by integration or homologous recombination, such as in the generation of a recombinant virus as described elsewhere herein.

As used herein, genetic therapy or gene therapy involves the transfer of heterologous nucleic acid, such as DNA or RNA, into certain cells, target cells, of a mammal, particularly a human, with a disorder or conditions for which such therapy is sought. As used herein, genetic therapy or gene therapy can involve the transfer of heterologous nucleic acid, such as DNA, into a virus, which can be transferred to a mammal, particularly a human, with a disorder or conditions for which such therapy is sought. The nucleic acid, such as DNA, is introduced into the selected target cells, such as directly or indirectly, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that is in some manner a therapeutic product, or which mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, a therapeutically effective product for gene therapy is a product that is encoded by heterologous nucleic acid, typically DNA, or an RNA product such as dsRNA, RNAi, including siRNA, that upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense nucleic acids.

As used herein, an agent or compound that modulates the activity of a protein or expression of a gene or nucleic acid either decreases or increases or otherwise alters the activity of the protein or, in some manner, up- or down-regulates or otherwise alters expression of the nucleic acid in a cell.

As used herein, recitation that amino acids of a polypeptide "correspond to" amino acids in a disclosed sequence, such as amino acids set forth in the Sequence listing, refers to amino acids identified upon alignment of the polypeptide with the disclosed sequence to maximize identity or homology (where conserved amino acids are aligned) using a standard alignment algorithm, such as the GAP algorithm. By aligning the sequences of polypeptides, one skilled in the art can identify corresponding residues, using conserved and identical amino acid residues as guides.

As used herein, "amino acids" are represented by their full name or by their known, three-letter or one-letter abbreviations (Table 1). The nucleotides which occur in the various nucleic acid fragments are designated with the standard single-letter designations used routinely in the art.

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

As used herein, the terms "homology" and "identity" are used interchangeably, but homology for proteins can include conservative amino acid changes. In general, to identify corresponding positions, the sequences of amino acids are aligned so that the highest order match is obtained (see, e.g., *Computational Molecular Biology*, Lesk, A. M., ed., Oxford University Press, New York, 1988; *Biocomputing: Informatics and Genome Proiects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well as identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well as identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage of homology vary). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215:403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

The term substantially identical or homologous or similar varies with the context as understood by those skilled in the relevant art and generally means at least 60% or 70%, preferably means at least 80%, more preferably at least 90%, and most preferably at least 95%, 96%, 97%, 98%, 99% or greater identity. As used herein, substantially identical to a product means sufficiently similar so that the property of interest is sufficiently unchanged so that the substantially identical product can be used in place of the product.

As used herein, substantially pure means sufficiently homogeneous to appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound can, however, be a mixture of stereoisomers or isomers. In such instances, further purification might increase the specific activity of the compound.

As used herein equivalent, when referring to two sequences of nucleic acids, means that the two sequences in question encode the same sequence of amino acids or equivalent proteins. When equivalent is used in referring to two proteins or peptides or other molecules, it means that the two proteins or peptides have substantially the same amino acid sequence with only amino acid substitutions (such as, but not limited to, conservative changes) or structure and that any changes do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, a receptor refers to a molecule that has an affinity for a ligand. Receptors can be naturally-occurring or synthetic molecules. Receptors also can be referred to in the art as anti-ligands. As used herein, the receptor and anti-ligand are interchangeable. Receptors can be used in their unaltered state or bound to other polypeptides, including as homodimers. Receptors can be attached to, covalently or noncovalently, or in physical contact with, a binding member, either directly or indirectly via a specific binding substance or linker. Examples of receptors, include, but are not limited to: antibodies, cell membrane receptors, surface receptors and internalizing receptors, monoclonal antibodies and antisera reactive with specific antigenic determinants (such as on viruses, cells, or other materials), drugs, polynucleotides, nucleic acids, peptides, cofactors, lectins, sugars, polysaccharides, cells, cellular membranes, and organelles.

As used herein, bind, bound and binding refer to the binding between atoms or molecules with a $K_d$ in the range of $10^{-2}$ to $10^{-15}$ mole/L, generally, $10^{-6}$ to $10^{-15}$, $10^{-7}$ to $10^{-15}$ and typically $10^{-8}$ to $10^{-15}$ (and/or a $K_a$ of $10^5$-$10^{12}$, $10^7$-$10^{12}$, $10^8$-$10^{12}$ L/mole).

As used herein, luminescence refers to the detectable electromagnetic (EM) radiation, generally, ultraviolet (UV), infrared (IR) or visible EM radiation that is produced when the excited product of an exergonic chemical process reverts to its ground state with the emission of light. Chemiluminescence is luminescence that results from a chemical reaction. Bioluminescence is chemiluminescence that results from a chemical reaction using biological molecules (or synthetic versions or analogs thereof) as substrates and/or enzymes. Fluorescence is luminescence in which light of a visible color is emitted from a substance under stimulation or excitation by light or other forms radiation such as ultraviolet (UV), infrared (IR) or visible EM radiation.

As used herein, chemiluminescence refers to a chemical reaction in which energy is specifically channeled to a molecule causing it to become electronically excited and subsequently to release a photon thereby emitting visible light. Temperature does not contribute to this channeled energy. Thus, chemiluminescence involves the direct conversion of chemical energy to light energy.

As used herein, bioluminescence, which is a type of chemiluminescence, refers to the emission of light by biological molecules, particularly proteins. The essential condition for bioluminescence is molecular oxygen, either bound or free in the presence of an oxygenase, a luciferase, which acts on a substrate, a luciferin. Bioluminescence is generated by an enzyme or other protein (luciferase) that is an oxygenase that acts on a substrate luciferin (a bioluminescence substrate) in the presence of molecular oxygen and transforms the substrate to an excited state, which, upon return to a lower energy level releases the energy in the form of light.

As used herein, the substrates and enzymes for producing bioluminescence are generically referred to as luciferin and luciferase, respectively. When reference is made to a particular species thereof, for clarity, each generic term is used with the name of the organism from which it derives such as, for example, click beetle luciferase or firefly luciferase.

As used herein, luciferase refers to oxygenases that catalyze a light emitting reaction. For instance, bacterial luciferases catalyze the oxidation of flavin mononucleotide (FMN) and aliphatic aldehydes, which reaction produces light. Another class of luciferases, found among marine arthropods, catalyzes the oxidation of Cypridina (Vargula) luciferin and another class of luciferases catalyzes the oxidation of Coleoptera luciferin.

Thus, luciferase refers to an enzyme or photoprotein that catalyzes a bioluminescent reaction (a reaction that produces bioluminescence). The luciferases, such as firefly and *Gaussia* and *Renilla* luciferases are enzymes which act catalytically and are unchanged during the bioluminescence generating reaction. The luciferase photoproteins, such as the aequorin photoprotein to which luciferin is non-covalently bound, are changed, such as by release of the luciferin, during bioluminescence generating reaction. The luciferase is a protein, or a mixture of proteins (e.g., bacterial luciferase), that occurs naturally in an organism or a variant or mutant thereof, such as a variant produced by mutagenesis that has one or more properties, such as thermal stability, that differ from the naturally-occurring protein. Luciferases and modified mutant or variant forms thereof are well known. For purposes herein, reference to luciferase refers to either the photoproteins or luciferases.

Thus, reference, for example, to *Renilla* luciferase refers to an enzyme isolated from member of the genus *Renilla* or an equivalent molecule obtained from any other source, such as from another related copepod, or that has been prepared synthetically. It is intended to encompass *Renilla* luciferases with conservative amino acid substitutions that do not substantially alter activity. Conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224).

As used herein, bioluminescence substrate refers to the compound that is oxidized in the presence of a luciferase and any necessary activators and generates light. These substrates are referred to as luciferins herein, are substrates that undergo oxidation in a bioluminescent reaction. These bioluminescence substrates include any luciferin or analog thereof or any synthetic compound with which a luciferase interacts to generate light. Typical substrates include those that are oxidized in the presence of a luciferase or protein in a light-generating reaction. Bioluminescence substrates, thus, include those compounds that those of skill in the art recognize as luciferins. Luciferins, for example, include firefly luciferin, Cypridina (also known as Vargula) luciferin (coelenterazine), bacterial luciferin as well as synthetic analogs of these substrates or other compounds that are oxidized in the presence of a luciferase in a reaction the produces bioluminescence.

As used herein, capable of conversion into a bioluminescence substrate refers to being susceptible to chemical reaction, such as oxidation or reduction, which yields a bioluminescence substrate. For example, the luminescence producing reaction of bioluminescent bacteria involves the reduction of a flavin mononucleotide group (FMN) to reduced flavin mononucleotide ($FMNH_2$) by a flavin reductase enzyme. The reduced flavin mononucleotide (substrate) then reacts with oxygen (an activator) and bacterial luciferase to form an intermediate peroxy flavin that undergoes further reaction, in the presence of a long-chain aldehyde, to generate light. With respect to this reaction, the reduced flavin and the long chain aldehyde are bioluminescence substrates.

As used herein, a bioluminescence generating system refers to the set of reagents required to conduct a bioluminescent reaction. Thus, the specific luciferase, luciferin and other substrates, solvents and other reagents that can be required to complete a bioluminescent reaction form a bioluminescence system. Thus a bioluminescence generating system refers to any set of reagents that, under appropriate reaction conditions, yield bioluminescence. Appropriate reaction conditions refer to the conditions necessary for a bioluminescence reaction to occur, such as pH, salt concentrations and temperature. In general, bioluminescence systems include a bioluminescence substrate, luciferin, a luciferase, which includes enzymes luciferases and photoproteins and one or more activators. A specific bioluminescence system can be identified by reference to the specific organism from which the luciferase derives; for example, the *Renilla* bioluminescence system includes a *Renilla* luciferase, such as a luciferase isolated from *Renilla* or produced using recombinant methods or modifications of these luciferases. This system also includes the particular activators necessary to complete the bioluminescence reaction, such as oxygen and a substrate with which the luciferase reacts in the presence of the oxygen to produce light.

As used herein, a fluorescent protein (FP) refers to a protein that possesses the ability to fluoresce (i.e., to absorb energy at one wavelength and emit it at another wavelength). For example, a green fluorescent protein (GFP) refers to a polypeptide that has a peak in the emission spectrum at 510 nm or about 510 nm. A variety of FPs that emit at various wavelengths are known in the art. Exemplary FPs include, but are not limited to, a green fluorescent protein (GFP), yellow fluorescent protein (YFP), orange fluorescent protein (OFP), cyan fluorescent protein (CFP), blue fluorescent protein (BFP), red fluorescent protein (RFP), far-red fluorescent protein, or near-infrared fluorescent protein. Extending the spectrum of available colors of fluorescent proteins to blue, cyan, orange, yellow and red variants, provides a method for multicolor tracking of fusion proteins.

As used herein, *Aequorea* GFP refers to GFPs from the genus *Aequorea* and to mutants or variants thereof. Such variants and GFPs from other species, such as Anthozoa reef coral, *Anemonia* sea anemone, *Renilla* sea pansy, *Galaxea* coral, *Acropora* brown coral, *Trachyphyllia* and *Pectimidae* stony coral and other species are well known and are available and known to those of skill in the art. Exemplary GFP variants include, but are not limited to BFP, CFP, YFP and OFP. Examples of florescent proteins and their variants include GFP proteins, such as Emerald (Invitrogen, Carlsbad, Calif.), EGFP (Clontech, Palo Alto, Calif.), Azami-Green (MBL International, Woburn, Mass.), Kaede (MBL International, Woburn, Mass.), ZsGreen1 (Clontech, Palo Alto, Calif.) and CopGFP (Evrogen/Axxora, LLC, San Diego, Calif.); CFP proteins, such as Cerulean (Rizzo, *Nat. Biotechnol.* 22(4): 445-9 (2004)), mCFP (Wang et al., *PNAS USA.* 101(48): 16745-9 (2004)), AmCyan1 (Clontech, Palo Alto, Calif.), MiCy (MBL International, Woburn, Mass.), and CyPet (Nguyen and Daugherty, *Nat. Biotechnol.* 23(3):355-60 (2005)); BFP proteins such as EBFP (Clontech, Palo Alto, Calif.); YFP proteins such as EYFP (Clontech, Palo Alto, Calif.), YPet (Nguyen and Daugherty, *Nat. Biotechnol.* 23(3): 355-60 (2005)), Venus (Nagai et al., *Nat. Biotechnol.* 20(1): 87-90 (2002)), ZsYellow (Clontech, Palo Alto, Calif.), and mCitrine (Wang et al., *PNAS USA.* 101(48):16745-9 (2004)); OFP proteins such as cOFP (Strategene, La Jolla, Calif.), mKO (MBL International, Woburn, Mass.), and mOrange; and others (Shaner N C, Steinbach P A, and Tsien R Y., *Nat. Methods.* 2(12):905-9 (2005)).

As used herein, red fluorescent protein, or RFP, refers to the *Discosoma* RFP (DsRed) that has been isolated from the corallimorph *Discosoma* (Matz et al., *Nature Biotechnology* 17: 969-973 (1999)), and red or far-red fluorescent proteins from any other species, such as *Heteractis* reef coral and *Actinia* or *Entacmaea* sea anemone, as well as variants thereof. RFPs include, for example, *Discosoma* variants, such as monomeric red fluorescent protein 1 (mRFP1), mCherry, tdTomato, mStrawberry, mTangerine (Wang et al., *PNAS USA.* 101(48):16745-9 (2004)), DsRed2 (Clontech, Palo Alto, Calif.), and DsRed-T1 (Bevis and Glick, *Nat. Biotechnol.,* 20: 83-87 (2002)), *Anthomedusa* J-Red (Evrogen) and *Anemonia* AsRed2 (Clontech, Palo Alto, Calif.). Far-red fluorescent proteins include, for example, *Actinia* AQ143 (Shkrob et al., *Biochem J.* 392(Pt 3):649-54 (2005)), Entacmaea eqFP611 (Wiedenmann et al. *Proc Natl Acad Sci USA.* 99(18):11646-51 (2002)), Discosoma variants such as mPlum and mRasberry (Wang et al., *PNAS USA.* 101(48): 16745-9 (2004)), and *Heteractis* HcRed1 and t-HcRed (Clontech, Palo Alto, Calif.).

As used herein the term assessing or determining is intended to include quantitative and qualitative determination in the sense of obtaining an absolute value for the activity of a product, and also of obtaining an index, ratio, percentage, visual or other value indicative of the level of the activity. Assessment can be direct or indirect.

As used herein, activity refers to the in vivo activities of a compound or viruses on physiological responses that result following in vivo administration thereof (or of a composition or other mixture). Activity, thus, encompasses resulting therapeutic effects and pharmaceutical activity of such compounds, compositions and mixtures. Activities can be observed in in vitro and/or in vivo systems designed to test or use such activities.

As used herein, a vaccine refers to a composition which, upon administration to a subject, elicits an immune response in a subject to which it is administered and which protects the immunized subject against subsequent challenge by the immunizing agent or an immunologically cross-reactive agent. A vaccine can be used to enhance the immune response against a pathogen, such as a virus, that expresses the immunological agent and/or has already infected the subject. Protection can be complete or partial (i.e., a reduction in symptoms or infection as compared with an unvaccinated subject). Typically a vaccine is administered to a subject that is a mammal. An immunologically cross-reactive agent can be, for example, the whole protein (e.g., tumor antigen) from which a subunit peptide used as the immunogen is derived. Alternatively, an immunologically cross-reactive agent can be a different protein which is recognized in whole or in part by the antibodies elicited by the immunizing agent. Exemplary vaccines can be modified vaccinia viruses that express an immunologically cross-reactive agent.

As used herein, a "pharmaceutically acceptable carrier" refers to any carrier, diluent, excipient, wetting agent, buffering agent, suspending agent, lubricating agent, adjuvant, solid binder, vehicle, delivery system, emulsifier, disintegrant, absorbent, preservative, surfactant, colorant, flavorant, or sweetener, preferably non-toxic, that are suitable for use in a pharmaceutical composition.

As used herein, complex refers generally to an association between two or more species regardless of the nature of the interaction between the species (i.e., ionic, covalent, or electrostatic).

As used herein, "a combination" refers to any association between two or among more items or elements. Exemplary combinations include, but are not limited to, two or more pharmaceutical compositions, a composition containing two or more active ingredients, such as two viruses, or a virus and a chemotherapeutic compound, two or more viruses, a virus and a therapeutic agent, a virus and an imaging agent, a virus and a plurality of therapeutic and/or imaging agents, or any association thereof. Such combinations can be packaged as kits.

As used herein, a composition refers to any mixture. It can be a solution, a suspension, an emulsion, liquid, powder, a paste, aqueous, non-aqueous or any combination of such ingredients.

As used herein, fluid refers to any composition that can flow. Fluids thus encompass compositions that are in the form of semi-solids, pastes, solutions, aqueous mixtures, gels, lotions, creams and other such compositions.

As used herein, a kit is a packaged combination, optionally, including instructions for use of the combination and/or other reactions and components for such use.

For clarity of disclosure, and not by way of limitation, the detailed description is divided into the subsections that follow.

B. VIRUSES FOR TREATMENT AND DIAGNOSIS

Provided herein are viruses for therapeutic and diagnostic use. Also provided elsewhere herein are methods for making and using such viruses for therapeutic and diagnostic use. The viruses provided herein are typically attenuated. Attenuated viruses have a decreased capacity to cause disease in a host. The decreased capacity can result from any of a variety of different modifications to the ability of a virus to be pathogenic. For example, a virus can have reduced toxicity, reduced ability to accumulate in non-tumorous organs or tissue, reduced ability to cause cell lysis or cell death, or reduced ability to replicate compared to the non-attenuated form thereof. The attenuated viruses provided herein, however, retain at least some capacity to replicate and to cause immunoprivileged cells and tissues, such as tumor cells to leak or lyse, undergo cell death, or otherwise cause or enhance an immune response to immunoprivileged cells and tissues, such as tumor cells. Such characteristics of the viruses provided are described in detail elsewhere herein.

The viruses provided herein can accumulate in immunoprivileged cells or immunoprivileged tissues, including tumors and/or metastases, and also including wounded tissues and cells. While the viruses provided herein can typically be cleared from the subject to whom the viruses are administered by activity of the subject's immune system, viruses can nevertheless accumulate, survive and proliferate in immunoprivileged cells and tissues such as tumors because such immunoprivileged areas are sequestered from the host's immune system. Accordingly, the methods provided herein, as applied to tumors and/or metastases, and therapeutic methods relating thereto, can readily be applied to other immunoprivileged cells and tissues, including wounded cells and tissues.

Among the viruses provided herein are cytoplasmic viruses, which do not require entry of viral nucleic acid molecules in to the nucleus of the host cell during the viral life cycle. Exemplary cytoplasmic viruses provided herein are viruses of the poxvirus family, including orthopoxviruses. Exemplary of poxviruses provided herein are vaccinia viruses. Vaccinia virus possesses a variety of features for use in cancer gene therapy and vaccination, including broad host and cell type range, a large carrying capacity for foreign genes and high sequence homology among different strains for designing and generating modified viruses in other strains. Techniques for production of modified vaccinia strains by genetic engineering are well established (Moss (1993) *Curr. Opin. Genet. Dev.* 3: 86-90; Broder and Earl (1999) *Mol. Biotechnol.* 13: 223-245; Timiryasova et al. (2001) *Biotechniques* 31: 534-540). A variety of vaccinia virus strains are available, including Western Reserve (WR), Copenhagen, Tashkent, Tian Tan, Lister, Wyeth, IHD-J, and IHD-W, Brighton, Ankara, MVA, Dairen I, LIPV, LC16M8, LC16MO, LIVP, WR 65-16, Connaught, New York City Board of Health. Exemplary of vaccinia viruses provided herein are Lister strain or LIVP vaccinia viruses.

The viruses provided herein are modified from their wild type form. Modifications can include any of a variety of changes, and include changes to the genome of the virus. Exemplary nucleic acid modifications include truncations, insertions, deletions and mutations. In an exemplary modification, a viral gene can be modified by truncation, insertion, deletion or mutation. Modifications of the viruses provided herein can result in a modification of virus characteristics, including those provided herein such as pathogenicity, toxicity, ability to preferentially accumulate in tumor, ability to lyse cells or cause cell death, ability to elicit an immune response against tumor cells, immunogenicity and replication competence.

Provided herein are vaccinia viruses with insertions, mutations or deletions, as provided in the Examples and described elsewhere herein. Exemplary insertions, mutations or deletions are those that result in an attenuated vaccinia virus relative to the wild type strain. For example, vaccinia virus insertions, mutations or deletions can decrease pathogenicity of the vaccinia virus, for example, by reducing the toxicity, reducing the infectivity, reducing the ability to replicate or reducing the number of non-tumor organs or tissues to which the vaccinia virus can accumulate. Other exemplary insertions, mutations or deletions include, but are not limited to, those that increase antigenicity of the virus, those that permit detection or imaging, those that alter attenuation of the virus, and those that alter infectivity. Modifications can be made, for example, in genes that are involved in nucleotide metabolism, host interactions and virus formation.

Any of a variety of insertions, mutations or deletions of the vaccinia virus known in the art can be used herein, including insertions, mutations or deletions of: the thymidine kinase (TK) gene, the hemagglutinin (HA) gene and F14.5L gene, among others provided elsewhere herein. The vaccinia viruses provided herein also can contain two or more insertions, mutations or deletions. Thus, included are vaccinia viruses containing two or more insertions, mutations or deletions of the loci provided herein or other loci known in the art.

Viruses provided herein can contain one or more heterologous nucleic acid molecules inserted into the genome of the virus. A heterologous nucleic acid molecule can contain an open reading frame or can be a non-coding sequence. In some cases, the heterologous nucleic acid replaces all or a portion of a viral gene. The viral gene can be replaced with homologous gene from another virus or a different gene. For example, vaccinia viruses provided herein can be modified by replacement of the A34R gene with another A34R gene from a different strain in order to increase the EEV form of the virus. In one example, the A34R gene from the Lister strain of vaccinia can be replaced with A34R gene from the IHD-J strain of vaccinia virus (see, e.g., Examples 1, 2; strain GLV-1i69).

The heterologous nucleic acid can be operably linked to a promoter for expression of an open reading frame. A heterologous nucleic acid that is operably linked to a promoter is also called an expression cassette. Hence, viruses provided herein can have the ability to express one or more heterologous genes. Gene expression can include expression of a protein encoded by a gene and/or expression of an RNA molecule encoded by a gene. In some embodiments, the viruses provided herein can express exogenous genes at levels high enough that permit harvesting products of the exogenous genes from the tumor. Expression of heterologous genes can be controlled by a constitutive promoter, or by an inducible promoter. Exogenous genes expressed can include genes encoding a therapeutic gene product, genes encoding a detectable gene product such as a gene product that can be used for imaging, genes encoding a gene product to be harvested, genes encoding an antigen for tumor therapy or for antibody to be harvested (e.g., vaccination). The viruses provided herein can be used for expressing genes in vivo and in vitro.

The heterologous gene expressed by the viruses provided herein can be controlled by a regulatory sequence. Suitable regulatory sequences which, for example, are functional in a mammalian host cell are well known in the art. In one example, the regulatory sequence can contain a natural or synthetic promoter. In another embodiment, the regulatory sequence contains a poxvirus promoter, such as a vaccinia virus promoter. Strong late promoters can be used to achieve high levels of expression of the foreign genes. Early and intermediate-stage promoters can also be used. In one embodiment, the promoters contain early and late promoter elements, for example, the vaccinia virus early/late promoter P7.5k, vaccinia late promoter P11k, a synthetic early/late vaccinia PSEL promoter (Patel et al., (1988) *Proc. Natl. Acad. Sci. USA* 85: 9431-9435; Davison and Moss, (1989) *J Mol Biol* 210: 749-769; Davison et al. (1990) *Nucleic Acids Res.* 18: 4285-4286; Chakrabarti et al. (1997), *BioTechniques* 23: 1094-1097). As described in the Examples and elsewhere herein, the viruses provided can exhibit differences in characteristics, such as attenuation, as a result of using a stronger promoter versus a weaker promoter. For example, in vaccinia, synthetic early/late and late promoters are relatively strong promoters, whereas vaccinia synthetic early, P7.5k early/late, P7.5k early, and P28 late promoters are relatively weaker promoters (see e.g., Chakrabarti et al. (1997) *BioTechniques* 23(6) 1094-1097).

The viruses provided herein can express one or more genes whose products are useful for tumor therapy. For example, a virus can express proteins that cause cell death or whose products cause an anti-tumor immune response. Such genes can be considered therapeutic genes. A variety of therapeutic gene products, such as toxic or apoptotic proteins, or siRNA, are known in the art, and can be used with the viruses provided herein. The therapeutic genes can act by directly killing the host cell, for example, as a channel-forming or other lytic protein, or by triggering apoptosis, or by inhibiting essential cellular processes, or by triggering an immune response against the cell, or by interacting with a compound that has a similar effect, for example, by converting a less active compound to a cytotoxic compound. Exemplary proteins useful for tumor therapy include, but are not limited to, tumor suppressors, toxins, cytostatic proteins and costimulatory molecules, such as cytokines and chemokines among others provided elsewhere herein and known in the art.

The viruses provided herein can be based on modifications to the Lister strain of vaccinia virus (e.g., LIVP). The modifications of the Lister strain provided herein can also be adapted to other vaccinia viruses (e.g., Western Reserve (WR), Copenhagen, Tashkent, Tian Tan, Lister, Wyeth, 1HD-J, and IHD-W, Brighton, Ankara, MVA, Dairen I, LIPV, LC16M8, LC16MO, LIVP, WR 65-16, Connaught, New York City Board of Health). The modifications of the Lister strain provided herein can also be adapted to other viruses, including, but not limited to, viruses of the poxvirus family, adenoviruses, herpes viruses and retroviruses.

Exemplary vaccinia viruses provided herein were derived from vaccinia virus strain GLV-1h68 (also named RVGL21, SEQ ID NO: 1). GLV-1h68, which has been described in U.S. Pat. Pub. No. 2005-0031643, contains DNA insertions gene loci of the vaccinia virus LIVP strain (a vaccinia virus strain, originally derived by adapting the Lister strain (ATCC Catalog No. VR-1549) to calf skin (Institute of Viral Preparations, Moscow, Russia, Al'tshtein et al., (1983) Dokl. Akad. Nauk USSR 285:696-699)). GLV-1h68 contains expression cassettes encoding detectable marker proteins in the F14.5L (also designated in LIVP as F3) gene locus, thymidine kinase (TK) gene locus, and hemagglutinin (HA) gene locus. An expression cassette containing a Ruc-GFP cDNA molecule (a fusion of DNA encoding Renilla luciferase and DNA encoding GFP) under the control of a vaccinia synthetic early/late promoter $P_{SEL}$ (($P_{SEL}$)Ruc-GFP) was inserted into the F14.5L gene locus; an expression cassette containing a DNA molecule encoding beta-galactosidase under the control of the vaccinia early/late promoter $P_{7.5k}$ (($P_{7.5k}$)LacZ) and DNA encoding a rat transferrin receptor positioned in the reverse orientation for transcription relative to the vaccinia synthetic early/late promoter $P_{SEL}$ (($P_{SEL}$)rTrfR) was inserted into the TK gene locus (the resulting virus does not express transferrin receptor protein since the DNA molecule encoding the protein is positioned in the reverse orientation for transcription relative to the promoter in the cassette); and an expression cassette containing a DNA molecule encoding β-glucuronidase under the control of the vaccinia late promoter $P_{11k}$ (($P_{11k}$)gusA) was inserted into the HA gene locus.

1. Viruses with Altered Infectivity

Provided herein are modifications of vaccinia viruses that alter the ability of the viruses to infect and replicate within tumors. Infectivity can be enhanced by modification of viral coat proteins that are involved in cellular infection or are targeted by the host immune system. Coat proteins, such as that A34R protein, affect sensitivity of the virus to complement and/or antibody neutralization. Exemplary modifications in coat proteins include mutations or replacement of viral coat proteins, which can increase production of resistant viral forms by the host cell. Also provided herein are modifications that increase or decrease the transcriptional and/or translational load on the virus. Exemplary modifications include insertion and/or deletion of gene expression cassettes or replacement of genes with non-coding heterologous nucleic acid, which increases or decreases the number of transcriptional/translational units carried by the virus.

a. Viruses with Modified Viral Proteins i. Increase in the Vaccinia EEV Form by Replacement of A34R Vaccinia virus replicates in cells and produces both intracellular virus (IMV, intracellular mature virus; IEV, intracellular enveloped virus) and extracellular virus (EEV, extracellular enveloped virus; CEV, cell-associated extracellular virus) (Smith et al. (1998) *Adv Exp Med Biol.* 440: 395-414). IMV represents approximately 99% of virus yield following replication by wild-type vaccinia virus strains. The IMV virus form is relatively stable in the outside environment, and is primarily responsible for spread between individuals; however, IMV virus does not spread efficiently within the infected host due to inefficient release from cells and sensitivity to complement and/or antibody neutralization. By contrast, the EEV form is released into the extracellular milieu and typically represents only approximately 1% of the viral yield (Smith et al. (1998) *Adv Exp Med Biol.* 440: 395-414). EEV is responsible for viral spread within the infected host and is relatively easily degraded outside of the host. In addition, the EEV form has developed several mechanisms to inhibit its neutralization within the bloodstream. EEV is relatively resistant to complement (Vanderplasschen et al. (1998) *Proc Natl Acad Sci USA.* 95(13): 7544-9) due to the incorporation of host cell inhibitors of complement into its outer membrane coat and secretion of vaccinia virus complement control protein (VCP) into local extracellular environment. In addition, EEV is relatively resistant to neutralizing antibody effects compared to IMV (Smith et al. (1997) *Immunol Rev.* 159: 137-54; Vanderplasschen et al. (1997) *J Gen Virol.* 78 (Pt 8): 2041-8). EEV is released at earlier time points following infection (e.g., 4-6 hours) than is IMV (which is only released during/after cell death), and therefore, spread of the EEV form is faster (Blasco et al. (1993) *J Virol.* 67(6):3319-25).

The EEV form of vaccinia virus has naturally acquired features for rapid and efficient spread through solid tumors locally and to regional or distant tumor sites. Since EEV is relatively resistant to complement effects and to antibody-mediated neutralization, when it is grown in a cell type from the same species, this virus form will have enhanced stability and retain activity longer in the blood following intravascular administration (Smith et al. (1998) *Adv Exp Med Biol.* 440: 395-414; Vanderplasschen et al., (1998) *Proc Natl Acad Sci USA.* (13):7544-9). This is particularly important for repeat administration once neutralizing antibody levels have increased and anti-cancer therapies require repeat administration. Therefore, increasing the EEV form of vaccinia, and other poxviruses, results in enhanced systemic efficacy. Polypeptides involved in the modulation of the EEV form of a poxvirus include, but are not limited to, A34R and B5R. A mutation at codon 151 of A34R from a lysine to an aspartic acid K151D mutation renders the A34R protein less able to tether the EEV form to the cell membrane. B5R is an EEV-membrane bound polypeptide that can bind complement. The total deletion of A43R can lead to increased EEV release, but markedly reduced infectivity of the viruses, while the K151D mutation increases EEV release while maintaining infectivity of the released viruses.

The ability of vaccinia viruses provided herein to infect and replicate within tumors can be enhanced by increasing the extracellular enveloped form of the virus (EEV). Vaccinia viruses provided herein can be modified by replacement of the A34R gene with another A34R gene from a different strain. In one example, the A34R gene from the Lister strain of vaccinia can be replaced with A34R gene from the IHD-J strain of vaccinia virus (see e.g., Examples 1, 2; strain GLV-1i69). A34R gene from the IHD-J strain contains a mutation that increases the percentage of EEV form of the virus. In another example, the A34R gene of the vaccinia viruses provided herein can also be mutated to increase the amount of EEV particles released.

ii. Deletion of A35R

Modification of viral proteins can also be employed to attenuate the viruses. Deletion of genes encoding viral proteins, such as A35R, can decrease the toxicity of vaccinia strains (Roper, R. L. (2006) *J. Virol.* 80(1) 306-313). The A35R deletion can attenuate toxicity of the virus when injected into mice without affecting viral properties, such as viral plaque size, viral replication, host range or viral infectivity/spread. Provided herein are viruses that have the A35R gene deleted (see e.g., Examples 1, 16; strains GLV-1j87, GLV-1j88 and GLV-1j89).

b. Viruses with Multiple Genome Insertions and/or Deletions

As described in the Examples, viruses provided herein can exhibit differences in characteristics, such as attenuation, as a result of inserting one or more expression cassettes into the viral genome, removing one or more expression cassettes from the viral genome or replacing one or more expression cassettes in the viral genome. For example, a decrease in attenuation was observed when one or more expression cassettes was removed from a viral genome, such as the viral genome of the recombinant vaccinia LIVP strain GLV-1h68. In some examples, vaccinia viruses provided herein can have one or more expression cassettes removed from a virus and replaced with a heterologous non-coding nucleic acid molecule (see, e.g., strains GLV-1h70, GLV-1h71, GLV-1h72, GLV-1h73, GLV-1h74, GLV-1h85, and GLV-1h86). In other examples, vaccinia viruses provided herein can have one or more expression cassettes removed from a virus and replaced with a heterologous nucleic acid molecule that encodes a polypeptide (see, e.g., strains GLV-1h81, GLV-1h82, GLV-1h83, GLV-1h84, GLV-1h84, GLV-1h90, GLV-1h91, GLV-1h92, GLV-1h96, GLV-1h97, GLV-1h98, GLV-1h104, GLV-1h105, GLV-1h106, GLV-1h107, GLV-1h108 and GLV-1h109).

Vaccinia viruses are provided herein that differ in the level of attenuation exhibited by the virus in vivo and in vitro. As described in the Examples, the level of attenuation was modified by altering the number of expression cassettes contained in the virus or by modifying one or more expression cassettes contained in the virus by removal or replacement. Such modifications can increase or decrease the transcriptional or translation load on the virus, resulting in an altered level of attenuation.

Vaccinia viruses provided herein can have one or more expression cassettes removed from GLV-1h68 and replaced with a heterologous non-coding DNA molecule. Exemplary viruses provided include GLV-1h70, GLV-1h71, GLV-1h72, GLV-1h73, GLV-1h74, GLV-1h85, and GLV-1h86. GLV-1h70 contains $(P_{SEL})$Ruc-GFP inserted into the F14.5L gene locus, $(P_{SEL})$rTrfR and $(P_{7.5k})$LacZ inserted into the TK gene locus, and a non-coding DNA molecule inserted into the HA gene locus in place of $(P_{11k})$gusA. GLV-1h71 contains a non-coding DNA molecule inserted into the F14.5L gene locus in place of $(P_{SEL})$Ruc-GFP, $(P_{SEL})$rTrfR and $(P_{7.5k})$LacZ inserted into the TK gene locus, and $(P_{11k})$gusA inserted into the HA gene locus. GLV-1h72 contains $(P_{SEL})$Ruc-GFP inserted into the F14.5L gene locus, a non-coding DNA molecule inserted into the TK gene locus in place of $(P_{SEL})$rTrfR and $(P_{7.5k})$LacZ, and $P_{11k}$ gusA inserted into the HA gene locus. GLV-1h73 contains a non-coding DNA molecule inserted into the F14.5L gene locus in place of $(P_{SEL})$Ruc-GFP, $(P_{SEL})$rTrfR and $(P_{7.5k})$LacZ inserted into the TK gene locus, and a non-coding DNA molecule inserted into the HA gene locus in place of $(P_{11k})$gusA. GLV-1h74 contains a non-coding DNA molecule inserted into the F14.5L gene locus in place of $(P_{SEL})$Ruc-GFP, a non-coding DNA molecule inserted into the TK gene locus in place of $(P_{SEL})$rTrfR and $(P_{7.5k})$LacZ, and a non-coding DNA molecule inserted into the HA gene locus in place of $(P_{11k})$gusA. GLV-1h85 contains a non-coding DNA molecule inserted into the F14.5L gene locus in place of $(P_{SEL})$Ruc-GFP, a non-coding DNA molecule inserted into the TK gene locus in place of $(P_{SEL})$rTrfR and $(P_{7.5k})$LacZ, and $(P_{11k})$gusA inserted into the HA gene locus. GLV-1h86 contains $(P_{SEL})$Ruc-GFP inserted into the F14.5L gene locus, a non-coding DNA molecule inserted into the TK gene locus in place of $(P_{SEL})$rTrfR and $(P_{7.5k})$LacZ, and a non-coding DNA molecule inserted into the HA gene locus in place of $(P_{11k})$gusA.

2. Viruses that Express Proteins for Tumor Imaging

The viruses provided herein can express one or more genes whose products are detectable or whose products can provide a detectable signal. A variety of detectable gene products, such as detectable proteins are known in the art, and can be used with the viruses provided herein. Detectable proteins include receptors or other proteins that can specifically bind a detectable compound, proteins that can emit a detectable signal such as a fluorescence signal, or enzymes that can catalyze a detectable reaction or catalyze formation of a detectable product.

A variety of DNA sequences encoding proteins that can emit a detectable signal or that can catalyze a detectable reaction, such as luminescent or fluorescent proteins, are known and can be used in the viruses and methods provided herein. Exemplary detectable gene products are described elsewhere herein and include, but are not limited to firefly luciferase (de Wet et al. (1987) *Mol. Cell. Biol.* 7: 725-737), *Renilla* luciferase from *Renilla renformis* (Lorenz et al. (1991) *PNAS USA* 88: 4438-4442), click beetle luciferase (CBG99; Wood et al. (1989) *Science* 244(4905): 700-2), green fluorescent protein from *Aequorea victoria* (Prasher et al. (1987) *Gene* 111: 229-233) and red fluorescent protein from the corallimorph Discosoma (Matz et al. (1999) *Nature Biotechnology* 17: 969-973). Additional detectable proteins include reporter proteins, such as *E. coli* β galactosidase (LacZ), β glucuronidase (gusA), xanthineguanine phosphoribosyltransferase (XGPRT).

In some examples, two or more detectable proteins are fused together to produce a single polypeptide. Provided herein are viruses that contain a gene encoding a *Renilla* luciferase fused to a green fluorescent protein, Ruc-GFP. Exemplary viruses include, but are not limited to, GLV-1h68, GLV-1i69, GLV-1j87, GLV-1h70, GLV-1h72, GLV-1h82, GLV-1h83, GLV-1h86, GLV-1h90, GLV-1h91, GLV-1h92, GLV-1h96, GLV-1h97, GLV-1h98, GLV-1h104, GLV-1h105, GLV-1h106, GLV-1h107, GLV-1h108 and GLV-1h109. These viruses contain an insertion of an expression cassette into the F14.5L gene locus, where the expression cassette encodes Ruc-GFP under the control of a vaccinia synthetic early/late promoter $P_{SEL}$.

In some examples, two or more detectable proteins are produced from a single transcript that produces two separate polypeptides during translation. Provided herein are viruses that contain a DNA encoding a click beetle luciferase (CBG99) and monomeric red fluorescent protein (mRFP1) connected through a picornavirus 2A element (e.g., GLV-1h84). During translation, the two proteins are cleaved into two individual proteins at the picornavirus 2A element (Osborn et al., *Mol. Ther.* 12: 569-74, 2005). GLV-1h84 contains an insertion of an expression cassette into the F14.5L gene locus, where the expression cassette encodes Ruc-GFP under the control of a vaccinia synthetic early/late promoter $P_{SEL}$.

A variety of gene products, such as proteins, that can specifically bind a detectable compound are known in the art, including receptors (e.g., transferrin receptor), metal binding proteins (e.g., ferritin), ligand binding proteins and antibodies. Any of a variety of detectable compounds can be used, and can be imaged by any of a variety of known imaging methods. Exemplary compounds include receptor ligands and antigens for antibodies. The ligand can be labeled according to the imaging method to be used. Exemplary imaging methods include any of a variety magnetic resonance methods, such as magnetic resonance imaging (MRI) and magnetic resonance spectroscopy (MRS), and also include any of a variety of tomographic methods, such as positron emission tomography (PET). An exemplary virus provided herein that expresses a protein that can bind a detectable compound is a vaccinia virus that expresses a ferritin. GLV-1h82 and GLV-1h83 contain an insertion of an expression cassette into the HA gene locus where the expression cassette encodes a ferritin from *E. coli* under the control of a vaccinia synthetic early/late promoter $P_{SEL}$. An exemplary virus provided herein that expresses a protein that can bind a detectable compound is a vaccinia virus that expresses a transferrin receptor. GLV-1h82 additionally contains an insertion of an expression cassette into the TK gene locus where the expression cassette encodes a transferrin receptor under the control of a vaccinia synthetic early/late promoter $P_{SEL}$.

3. Viruses that Express Proteins for Tumor Treatment

Viruses provided herein can express one or more therapeutic gene products. Such proteins can inhibit tumor growth or whose products cause an anti-tumor immune response. Among the vaccinia viruses provided herein are vaccinia viruses that express protein for inhibition of angiogenesis and/or suppression of tumor cell growth. Particular viruses that express therapeutic gene products are Lister strain vaccinia viruses. Exemplary Lister strain vaccinia viruses are provided here and described elsewhere herein.

a. Proteins for Inhibiting Angiogenesis

Among the vaccinia viruses provided herein are vaccinia viruses that express protein for inhibition of blood vessel formation. Inhibition of angiogenesis promotes inhibition of tumor growth by inhibiting vascularization of the tumor needed for the expansion of the tumor mass.

i. hk5

In one example, viruses provided herein are modified to express the plasminogen K5 domain. Plasminogen kringle 5 is a potent angiogenesis inhibitor, which has been shown to induce apoptosis of endothelial cells and inhibit their migration. Human plasminogen kringle 5 has also been shown to induce apoptosis of tumor cells (Davidson et al. (2005) *Cancer Res.* 65: 4663-4672). Exemplary vaccinia viruses that express the plasminogen K5 domain under the control of the vaccinia synthetic early-late promoter are provided herein and described in further detail in the Examples (e.g., GLV-1h71).

ii. tTF-RGD

In one example, viruses provided herein are modified to express a fusion protein containing a truncated human tissue factor protein fused to an RGD peptide (tTF-RGD). The fusion protein binds selectively to tumor vessel endothelial cells via the RGD peptide portion. The tissue factor is able to activate blood clotting once bound to the tumor vessel endothelial cells, which in turn inhibits neovascularization of the tumor. Vaccinia viruses provided herein can effect tumor localized expression of tTF-RGD for the inhibition of tumor vascularization. Exemplary vaccinia viruses that express tTF-RGD under the control of a vaccinia synthetic early promoter, vaccinia synthetic early/late promoter or vaccinia synthetic late promoter are provided herein and described in further detail in the Examples (e.g., GLV-1h104, GLV-1h105 and GLV-1h106).

iii. Anti-VEGF scAb

In one example, viruses provided herein are modified to express a fusion protein containing a single chain anti-VEGF antibody fused to an FLAG peptide (G6-FLAG). Vascular endothelial growth factor (VEGF) functions as a major inducer of angiogenesis. Monoclonal antibodies directed against VEGF can inhibit tumor growth in mice and is effective in inhibiting tumor growth in the treatment of cancer patients. Single-chain Ab fragments (scFvs or scAb) derived from anti-VEGF antibodies are also potent inhibitors of vascularization have been shown to reduce the growth of subcutaneous tumors in nude mice (Vitaliti et al. (2000) *Cancer Research* 60, 4311-4314). Vaccinia viruses provided herein can effect tumor localized expression of scAb VEGF antibodies for the inhibition of tumor vascularization. Exemplary vaccinia viruses that express G6-FLAG under the control of a vaccinia synthetic early promoter, vaccinia synthetic early/late promoter or vaccinia synthetic late promoter are provided herein and described in further detail in the Examples (e.g., GLV-1h107, GLV-1h108 and GLV-1h109).

c. Proteins for Tumor Growth Suppression i. sIL-6R-IL-6

In one example, viruses provided herein are modified to express a fusion protein containing an IL-6 fused to an IL-6 receptor (sIL-6R/IL-6). The sIL-6R/IL-6 fusion polypeptide is an effective suppressor of tumor cell growth (see e.g., U.S. Pat. No. 7,112,436; U.S. Patent Application Serial No. 2007-0172455; Özbek et al. (2001) *Oncogene* 20(8): 972-979). Vaccinia viruses provided herein can effect tumor localized expression of sIL-6R-IL-6 for the inhibition of tumor cell growth. Exemplary vaccinia viruses that express sIL-6R-IL-6 under the control of a vaccinia synthetic early promoter, vaccinia synthetic early/late promoter or vaccinia synthetic late promoter are provided herein and described in further detail in the Examples (e.g., GLV-1h90, GLV-1h91 and GLV-1h92).

ii. IL-24

In one example, viruses provided herein are modified to express interleukin-24 (IL-24). IL-24, also called, mda-7 or melanoma differentiation gene is a potent inhibitor of tumor cell growth (see e.g., U.S. Pat. No. 5,710,137 and U.S. Patent Application Serial No. 2006-0134801). Vaccinia viruses provided herein can effect tumor localized expression of IL-24 for the inhibition of tumor cell growth. Exemplary vaccinia viruses that express IL-24 under the control of a vaccinia synthetic early promoter, vaccinia synthetic early/late promoter or vaccinia synthetic late promoter are provided herein and described in further detail in the Examples (e.g., GLV-1h96, GLV-1h97 and GLV-1h98).

4. Viruses that Express Proteins for Combined Tumor Diagnosis and Treatment

Provided herein are viruses that express a detectable protein and therapeutic protein. For example, viruses provided herein can express a detectable protein, such as Ruc-GFP fusion protein, and therapeutic protein, such as protein for tumor therapy. Exemplary tumor therapeutic proteins expressed by viruses provided herein include, but are not limited to, proteins that stimulate the host immune response (e.g., IL-6 and IL-24) and proteins that inhibit angiogenesis (e.g., tTF-RGD and anti-VEGF Abs). In some examples the detectable protein is Ruc-GFP and the therapeutic protein is sIL-6R-IL-6 fusion protein (e.g., GLV-1h90, GLV-1h91 and GLV-1h92). In other examples, the detectable protein is Ruc-GFP and the therapeutic protein is IL-24 (e.g., GLV-1h96, GLV-1h97 and GLV-1h98). In other examples, the detectable protein is Ruc-GFP and the therapeutic protein is tTF-RGD fusion protein (e.g., GLV-1h104, GLV-1h105 and GLV-1h106). In other examples, the detectable protein is Ruc-GFP and the therapeutic protein is anti-VEGF scAb (G6)-FLAG fusion protein (e.g., GLV-1h107, GLV-1h109 and GLV-1h109).

Viruses that express both a detectable protein and therapeutic protein can be used to detect and treat tumors. Such viruses can also be employed to monitor tumor growth/regression over the course of treatment, to monitor the efficacy of a particular tumor treatment regimen or to monitor the efficacy of combinations of tumor treatments. The viruses can be modified to express two or more therapeutic proteins to assess the efficacy of a combination of therapies.

C. FURTHER MODIFICATIONS OF VIRUSES PROVIDED

Viruses provided herein can be further modified by any known method for modifying a virus. Furthermore, viruses provided herein and viruses produced by the methods provided herein can be further modified to attenuate the virus. Hence, the methods provided herein can be combined with any known method for modifying a virus. Furthermore, the methods provided herein can be combined with any known method for modulating the attenuation of a virus. For example, such methods include modification of one or more viral genes, such as by a point mutation, a deletion mutation, an interruption by an insertion, a substitution or a mutation of the viral gene promoter or enhancer regions.

Further modifications of the viruses provided can enhance one or more characteristics of the virus. Such characteristics can include, but are not limited to, attenuated pathogenicity, reduced toxicity, preferential accumulation in tumor, increased ability to activate an immune response against tumor cells, increased immunogenicity, increased or decreased replication competence, and are able to express exogenous proteins, and combinations thereof. In some embodiments, the modified viruses have an ability to activate an immune response against tumor cells without aggressively killing the tumor cells. In other embodiments, the viruses can be modified to express one or more detectable genes, including genes that can be used for imaging. In other embodiments, the viruses can be modified to express one or more genes for harvesting the gene products and/or for harvesting antibodies against the gene products.

1. Modification of Viral Genes

Methods for modifying a virus include modifications in one or more viral genes. Modification can include those that inactivate viral gene or abolish or decrease the activity of a viral gene product. Such modifications in a viral gene can alter the viral processes, such as, for example, viral infectivity, viral DNA replication, viral protein synthesis, virus particle assembly and maturation, and viral particle release. Exemplary viral genes for modification include, but are not limited to, viral surface antigens (e.g. proteins that mediate viral attachment to host cell receptors), viral proteases, and viral enzymes involved in viral replication and transcription of viral genes (e.g., polymerases, replicases and helicases). Modifications in such genes can decrease the overall replication of the virus and production of viral particles thus resulting in a more attenuated virus.

In another embodiment, a viral surface antigen gene can be modified to produce a chimeric protein such that the heterologous epitope is expressed on the surface of the virus. Viruses expressing such chimeric proteins are thus useful as vaccines for use in generating an immune response in the host subject. Exemplary epitopes include but are not limited to tumor antigens, viral and bacterial antigens. Many exemplary antigens are known in the art, and include, for example, those listed and/or described in Novellino et al. (2005) *Cancer Immunol Immunother.* 54(3): 187-207; Eisenberger et al. (2006) *Hematol Oncol Clin North Am.* 20(3):661-87. In one embodiment, insertion of a heterologous epitope into the viral gene can affect the level of attenuation of the virus. In an alternative embodiment, the level of attenuation of the virus is unaffected by insertion of a heterologous epitope into the viral gene.

2. Expression of Additional Heterologous Genes

Viruses provided herein and viruses generated using the methods provided herein can be further modified to express one or more additional heterologous genes. Gene expression can include expression of a protein encoded by a gene and/or expression of an RNA molecule encoded by a gene. In some embodiments, the viruses can express heterologous genes at levels high enough that permit harvesting products of the heterologous gene from the tumor.

Expression of heterologous genes can be controlled by a constitutive promoter, or by an inducible promoter. Expression can also be influenced by one or more proteins or RNA molecules expressed by the virus. An exemplary inducible promoter system can include a chimeric transcription factor comprising a yeast GAL4 DNA-binding domain fused to a ligand binding domain derived from a progesterone receptor and to the activation domain of the herpes simplex virus protein VP16, and a synthetic promoter containing a series of GAL4 recognition sequences upstream of the adenovirus major late E1B TATA box, linked to one or more heterologous genes; in this exemplary system, administration of mifepristone (RU486) to a subject can result in induction of the heterologous genes. Other exemplary inducible promoter systems include, but are not limited to, a tetracycline-repressed regulated system, ecdysone-regulated system, and rapamycin-regulated system (Agha-Mohammadi and Lotze (2000) *J. Clin. Invest.* 105(9): 1177-1183). Heterologous genes expressed can include genes encoding a therapeutic gene product, genes encoding a detectable gene product, such as a gene product that can be used for imaging, genes encoding a gene product to be harvested, genes encoding an antigen of an antibody to be harvested or to elicit an immune response. The viruses provided herein can be used for expressing genes in vivo and in vitro. Exemplary proteins include reporter proteins (*E. coli* β-galactosidase, β-glucuronidase, xanthineguanine phosphoribosyltransferase), proteins facilitating detection, such as a detectable protein or a protein capable of inducing a detectable signal, (luciferase, fluorescent proteins, transferrin receptor, for example), proteins useful for tumor therapy (pseudomonas A endotoxin, diphtheria toxin, p53, Arf, Bax, tumor necrosis factor-alpha, HSV TK, *E. coli* purine nucleoside phosphorylase, angiostatin, endostatin, cytokines, or chemokines) and other proteins.

a. Detectable Gene Product

Viruses provided herein and viruses generated using the methods provided herein can express one or more genes whose products are detectable or whose products can provide a detectable signal. A variety of detectable gene products, such as detectable proteins are known in the art, and can be used with the viruses provided herein. Detectable proteins include receptors or other proteins that can specifically bind a detectable compound, proteins that can emit a detectable signal such as a fluorescence signal, and enzymes that can catalyze a detectable reaction or catalyze formation of a detectable product.

In some embodiments, the virus expresses a gene encoding a protein that can emit a detectable signal or that can catalyze a detectable reaction. A variety of DNA sequences encoding proteins that can emit a detectable signal or that can catalyze a detectable reaction, such as luminescent or fluorescent proteins, are known and can be used in the viruses and methods provided herein. Exemplary genes encoding light-emitting proteins include genes from bacterial luciferase from *Vibrio harveyi* (Belas et al., *Science* 218 (1982), 791-793), bacterial luciferase from *Vibrio fischerii* (Foran and Brown, *Nucleic acids Res.* 16 (1988), 177), firefly luciferase (de Wet et al., *Mol. Cell. Biol.* 7 (1987), 725-737), aequorin from *Aequorea victoria* (Prasher et al., *Biochem.* 26 (1987), 1326-1332), *Renilla* luciferase from *Renilla renformis* (Lorenz et al, *PNAS USA* 88 (1991), 4438-4442) and green fluorescent protein from *Aequorea victoria* (Prasher et al., *Gene* 111: 229-233 (1987)). The luxA and luxB genes of bacterial luciferase can be fused to produce the fusion gene ($Fab_2$), which can be expressed to produce a fully functional luciferase protein (Escher et al., *PNAS* 86: 6528-6532 (1989)). Transformation and expression of these genes in viruses can permit detection of viral infection, for example, using a low light and/or fluorescence imaging camera. In some embodiments, luciferases expressed by viruses can require exogenously added substrates such as decanal or coelenterazine for light emission. In other embodiments, viruses can express a complete lux operon, which can include proteins that can provide luciferase substrates such as decanal. For example, viruses containing the complete lux operon sequence, when injected intraperitoneally, intramuscularly, or intravenously, allowed the visualization and localization of microorganisms in live mice indicating that the luciferase light emission can penetrate the tissues and can be detected externally (Contag et al. (1995) *Mol. Microbiol.* 18: 593-603).

In other embodiments, the virus can express a gene that can bind a detectable compound or that can form a product that can bind a detectable compound. A variety of gene products, such as proteins, that can specifically bind a detectable compound are known in the art, including receptors, metal binding proteins (e.g., siderophores, ferritins, transferrin receptors), ligand binding proteins, and antibodies. Any of a variety of detectable compounds can be used, and can be imaged by any of a variety of known imaging methods. Exemplary compounds include receptor ligands and antigens for antibodies. The ligand can be labeled according to the imaging method to be used. Exemplary imaging methods include any of X-rays, a variety of magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography.

Labels appropriate for X-ray imaging are known in the art, and include, for example, Bismuth (III), Gold (III), Lanthanum (III) or Lead (II); a radioactive ion, such as $^{67}$Copper, $^{67}$Gallium, $^{68}$Gallium, $^{111}$Indium, $^{113}$Indium, $^{123}$Iodine, $^{125}$Iodine, $^{103}$Iodine, $^{197}$Mercury, $^{203}$Mercury, $^{186}$Rhenium, $^{188}$Rhenium, $^{97}$Rubidium, $^{103}$Rubidium, $^{99}$Technetium or $^{90}$Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Labels appropriate for magnetic resonance imaging are known in the art, and include, for example, gadolinium chelates and iron oxides. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as $^{123}$I. Other exemplary radionuclides that can be used, for example, as tracers for PET include $^{55}$Co, $^{67}$Ga, $^{68}$Ga, $^{60}$Cu (II), $^{67}$Cu(II), $^{57}$Ni, $^{52}$Fe and $^{18}$F (e.g., $^{18}$F-fluorodeoxyglucose (FDG)). Examples of useful radionuclide-labeled agents are $^{64}$Cu-labeled engineered antibody fragment (Wu et al. (2002) *PNAS USA* 97: 8495-8500), $^{64}$Cu-labeled somatostatin (Lewis et al. (1999) *J. Med. Chem.* 42: 1341-1347), $^{64}$Cu-pyruvaldehyde-bis N4-methylthiosemicarbazone)($^{64}$Cu-PTSM) (Adonai et al. (2002) *PNAS USA* 99: 3030-3035), $^{52}$Fe-citrate (Leenders et al. (1994) *J. Neural. Transm. Suppl.* 43: 123-132), $^{52}$Fe/$^{52m}$Mn-citrate (Calonder et al. (1999) *J. Neurochem.* 73: 2047-2055) and $^{52}$Fe-labeled iron (III) hydroxide-sucrose complex (Beshara et al. (1999) *Br. J. Haematol.* 104: 288-295, 296-302).

In some examples dual imaging in vitro and/or in vivo can be used to detect two or more detectable gene products, gene products that produce a detectable signal, gene products that can bind a detectable compound, or gene products that can bind other molecules to form a detectable product. In some examples, the two or more gene products are expressed by different viruses, whereas in other examples the two or more gene products are produced by the same virus. For example, a virus can express a gene product that emits a detectable signal and also express a gene product that catalyzes a detectable reaction. In other examples, a virus can express one or more gene products that emit a detectable signal, one or more gene products that catalyze a detectable reaction, one or more gene products that can bind a detectable compound or that can form a detectable product, or any combination thereof. Any combination of such gene products can be expressed by the viruses provided herein and can be used in combination with any of the methods provided herein. Imaging of such gene products can be performed, for example, by various imaging methods as described herein and known in the art (e.g., fluorescence imaging, MRI, PET, among many other methods of detection). Imaging of gene products can also be performed using the same method, whereby gene products are distinguished by their properties, such as by differences in wavelengths of light emitted. For example, a virus can express more than one fluorescent protein that differs in the wavelength of light emitted (e.g., a GFP and an RFP). In another non-limiting example, an RFP can be expressed with a luciferase. In yet other non-limiting examples, a fluorescent gene product can be expressed with a gene product, such as a ferritin or a transferrin receptor, used for magnetic resonance imaging. A virus expressing two or more detectable gene products or two or more viruses expressing two or more detectable gene products can be imaged in vitro or in vivo using such methods. In some embodiments the two or more gene products are expressed as a single polypeptide, such as a fusion protein. For example a fluorescent protein can be expressed as a fusion protein with a luciferase protein.

b. Therapeutic Gene Product

Viruses provided herein and viruses generated using the methods provided herein can express one or more genes whose products cause cell death or whose products cause an anti-tumor immune response; such genes can be considered therapeutic genes. A variety of therapeutic gene products, such as toxic or apoptotic proteins, or siRNA, are known in the art, and can be used with the viruses provided herein. The therapeutic genes can act by directly killing the host cell, for example, as a channel-forming or other lytic protein, or by triggering apoptosis, or by inhibiting essential cellular processes, or by triggering an immune response against the cell, or by interacting with a compound that has a similar effect, for example, by converting a less active compound to a cytotoxic compound. A large number of therapeutic proteins that can be expressed for tumor treatment are known in the art, including, but not limited to, tumor suppressors, toxins, cytostatic proteins and costimulatory molecules such as cytokines and chemokines. Costimulatory molecules for the methods provided herein include any molecules which are capable of enhancing immune responses to an antigen/pathogen in vivo and/or in vitro. Costimulatory molecules also encompass any molecules which promote the activation, proliferation, differentiation, maturation or maintenance of lymphocytes and/or other cells whose function is important or essential for immune responses. An exemplary, non-limiting list of therapeutic proteins includes WT1, p53, p16, Rb, BRCA1, cystic fibrosis transmembrane regulator (CFTR), Factor VIII, low density lipoprotein receptor, beta-galactosidase, alpha-galactosidase, beta-glucocerebrosidase, insulin, parathyroid hormone, alpha-1-antitrypsin, rsCD40L, Fas-ligand, TRAIL, TNF, antibodies, microcin E492, diphtheria toxin, *Pseudomonas exotoxin, Escherichia coli* Shiga toxin, *Escherichia coli* Verotoxin 1, and hyperforin. Exemplary cytokines include, but are not limited to, chemokines and classical cytokines, such as the interleukins, including for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factor (GM-CSF) and exemplary chemokines including, but not limited to CXC chemokines such as IL-8 GROα, GROβ, GROγ, ENA-78, LDGF-PBP, GCP-2, PF4, Mig, IP-10, SDF-1α/β, BUNZO/STRC33, I-TAC, BLC/BCA-1; CC chemokines such as MIP-1α, MIP-1β, MDC, TECK, TARC, RANTES, HCC-1, HCC-4, DC-CK1, MIP-3α, MIP-3β, MCP-1, MCP-2, MCP-3, MCP-4, Eotaxin, Eotaxin-2/MPIF-2, I-309, MIP-5/HCC-2, MPIF-1, 6Ckine, CTACK, MEC; lymphotactin; and fractalkine. Exemplary other costimulatory molecules include immunoglobulin superfamily of cytokines, such as B7.1, B7.2.

In other embodiments, the viruses can express a protein that converts a less active compound into a compound that causes tumor cell death. Exemplary methods of conversion of such a prodrug compound include enzymatic conversion and photolytic conversion. A large variety of protein/compound pairs are known in the art, and include, but are not limited to, Herpes simplex virus thymidine kinase/ganciclovir, Herpes simplex virus thymidine kinase/(E)-5-(2-bromovinyl)-2'-deoxyuridine (BVDU), varicella zoster thymidine kinase/ganciclovir, varicella zoster thymidine kinase/BVDU, varicella zoster thymidine kinase/(E)-5-(2-bromovinyl)-1-beta-D-arabinofuranosyluracil (BVaraU), cytosine deaminase/5-fluorouracil, cytosine deaminase/5-fluorocytosine, purine nucleoside phosphorylase/6-methylpurine deoxyriboside, beta lactamase/cephalosporin-doxorubicin, carboxypeptidase G2/4-[(2-chloroethyl)(2 mesyloxyethyl)amino]benzoyl-L-glutamic acid (CMDA), carboxypeptidase A/methotrexate-phenylamine, cytochrome P450/acetominophen, cytochrome P450-2B1/cyclophosphamide, cytochrome P450-4B1/2-aminoanthracene, 4-ipomeanol, horseradish peroxidase/indole-3-acetic acid, nitroreductase/CB1954, rabbit carboxylesterase/7-ethyl-10-[4-(1-piperidino)-1-piperidino]carbonyloxycamptothecin (CPT-11), mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin glucuronide, thymidine phosphorylase/5'-deoxy-5-fluorouridine, deoxycytidine kinase/cytosine arabinoside, and linamerase/linamarin.

In another embodiment, the therapeutic gene product can be an siRNA molecule. The siRNA molecule can be directed against expression of a tumor-promoting gene, such as, but not limited to, an oncogene, growth factor, angiogenesis promoting gene, or a receptor. The siRNA molecule also can be directed against expression of any gene essential for cell growth, cell replication or cell survival. The siRNA molecule also can be directed against expression of any gene that stabilizes the cell membrane or otherwise limits the number of tumor cell antigens released from the tumor cell. Design of an siRNA can be readily determined according to the selected target of the siRNA; methods of siRNA design and down-regulation of genes are known in the art, as exemplified in U.S. Pat. Pub. No. 2003-0198627.

In another embodiment, the therapeutic gene product can be a viral attenuation factor. Antiviral proteins or peptides can be expressed by the viruses provided herein. Expression of antiviral proteins or peptides can control viral pathogenicity. Exemplary viral attenuation factors include, but are not limited to, virus-specific antibodies, mucins, thrombospondin, and soluble proteins such as cytokines, including, but not limited to TNFα, interferons (for example IFNα, IFNβ, or IFNγ) and interleukins (for example IL-1, IL-12 or IL-18).

In another embodiment, the therapeutic gene product can be a protein ligand, such as antitumor oligopeptide. Antitumor oligopeptides are short protein peptides with high affinity and specificity to tumors. Such oligopeptides could be enriched and identified using tumor-associated phage libraries (Akita et al. (2006) *Cancer Sci*. 97(10):1075-1081). These oligopeptides have been shown to enhance chemotherapy (U.S. Pat. No. 4,912,199). The oligopeptides can be expressed by the viruses provided herein. Expression of the oligopeptides can elicit anticancer activities on their own or in combination with other chemotherapeutic agents. An exemplary group of antitumor oligopeptides is antimitotic peptides, including, but not limited to, tubulysin (Khalil et al. (2006) *Chembiochem*. 7(4):678-683), phomopsin, hemiasterlin, taltobulin (HTI-286, 3), and cryptophycin. Tubulysin is from myxobacteria and can induce depletion of cell microtubules and trigger the apoptotic process. The antimitotic peptides can be expressed by the viruses provide herein and elicit anticancer activities on their own or in combination with other therapeutic modalities.

In another embodiment, the therapeutic gene product can be a protein that sequesters molecules or nutrients needed for tumor growth. For example, the virus can express one or more proteins that bind iron, transport iron, or store iron, or a combination thereof. Increased iron uptake and/or storage by expression of such proteins not only, increases contrast for visualization and detection of a tumor or tissue in which the virus accumulates, but also depletes iron from the tumor environment. Iron depletion from the tumor environment removes a vital nutrient from the tumors, thereby deregulating iron hemostasis in tumor cells and delaying tumor progression and/or killing the tumor.

Additionally, iron, or other labeled metals, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor, wound, area of inflammation or infection allows the internalization of iron alone, a supplemental imaging moiety, or a therapeutic agent (which can deliver cytotoxicity specifically to tumor cells or deliver the therapeutic agent for treatment of the wound, area of inflammation or infection). These methods can be combined with any of the other methods provided herein.

c. Superantigen

The viruses provided herein can be modified to express one or more superantigens. Superantigens are antigens that can activate a large immune response, often brought about by a large response of T cells. A variety of superantigens are known in the art including, but not limited to, diphtheria toxin, staphylococcal enterotoxins (SEA, SEB, SEC1, SEC2, SED, SEE and SEH), Toxic Shock Syndrome Toxin 1, Exfoliating Toxins (EXft), Streptococcal Pyrogenic Exotoxin A, B and C (SPE A, B and C), Mouse Mammary Tumor Virus proteins (MMTV), Streptococcal M proteins, Clostridial Perfringens Enterotoxin (CPET), Listeria monocytogenes antigen p60, and mycoplasma arthritis superantigens.

Since many superantigens also are toxins, if expression of a virus of reduced toxicity is desired, the superantigen can be modified to retain at least some of its superantigenicity while reducing its toxicity, resulting in a compound such as a toxoid. A variety of recombinant superantigens and toxoids of superantigens are known in the art, and can readily be expressed in the viruses provided herein. Exemplary toxoids include toxoids of diphtheria toxin, as exemplified in U.S. Pat. No. 6,455,673 and toxoids of Staphylococcal enterotoxins, as exemplified in U.S. Pat. Pub. No. 20030009015.

d. Gene Product to be Harvested

Exemplary genes expressible by a virus provided herein for the purpose of harvesting include human genes. An exemplary list of genes includes the list of human genes and genetic disorders authored and edited by Dr. Victor A. McKusick and his colleagues at Johns Hopkins University and elsewhere, and developed for the World Wide Web by NCBI, the National Center for Biotechnology Information. Online Mendelian Inheritance in Man, OMIM™, Center for Medical Genetics, Johns Hopkins University (Baltimore, Md.) and National Center for Biotechnology Information, National Library of Medicine (Bethesda, Md.), and those available in public databases, such as PubMed and GenBank (see, for example, genes provided in the website ncbi.nlm.nih.gov/entrez/query.fcgi?db=OMIM).

e. Control of Heterologous Gene Expression

In one embodiment, expression of the therapeutic compound can be controlled by a regulatory sequence. Suitable regulatory sequences which, for example, are functional in a mammalian host cell are well known in the art. In one example, the regulatory sequence contains a poxvirus promoter. In another embodiment, the regulatory sequence can contain a natural or synthetic vaccinia virus promoter. Exemplary vaccinia early, intermediate and late stage promoters include, for example, vaccinia $P_{7.5k}$ early/late promoter, vaccinia $P_{EL}$ early/late promoter, vaccinia $P_{13}$ early promoter, vaccinia $P_{11k}$ late promoter and vaccinia promoters listed elsewhere herein. Exemplary synthetic promoters include, for example, $P_{SE}$ synthetic early promoter, $P_{SEL}$ synthetic early/late promoter, $P_{SL}$ synthetic late promoter, vaccinia synthetic promoters listed elsewhere herein (Patel et al., Proc. Natl. Acad. Sci. USA 85: 9431-9435 (1988); Davison and Moss, J Mol Biol 210: 749-769 (1989); Davison et al., Nucleic Acids Res. 18: 4285-4286 (1990); Chakrabarti et al., BioTechniques 23: 1094-1097 (1997)). Combinations of different promoters can be used to express different gene products in the same virus or two different viruses. In one embodiment, different therapeutic or detectable gene products are expressed from different promoters, such as two different vaccinia synthetic promoters.

D. METHODS FOR MAKING A MODIFIED VIRUS

The viruses provided herein can be formed by standard methodologies well known in the art for modifying viruses. Briefly, the methods include introducing into viruses one or more genetic modifications, followed by screening the viruses for properties reflective of the modification or for other desired properties.

1. Genetic Modifications

Standard techniques in molecular biology can be used to generate the modified viruses provided herein. Such techniques include various nucleic acid manipulation techniques, nucleic acid transfer protocols, nucleic acid amplification protocols, and other molecular biology techniques known in the art. For example, point mutations can be introduced into a gene of interest through the use of oligonucleotide mediated site-directed mutagenesis. Alternatively, homologous recombination can be used to introduce a mutation or exogenous sequence into a target sequence of interest. In an alternative mutagenesis protocol, point mutations in a particular gene can also be selected for using a positive selection pressure. See, e.g., Current Techniques in Molecular Biology, (Ed. Ausubel, et al.). Nucleic acid amplification protocols include but are not limited to the polymerase chain reaction (PCR). Use of nucleic acid tools such as plasmids, vectors, promoters and other regulating sequences, are well known in the art for a large variety of viruses and cellular organisms. Nucleic acid transfer protocols include calcium chloride transformation/transfection, electroporation, liposome mediated nucleic acid transfer, N-[1-(2,3-Dioloyloxy)propyl]-N,N,N-trimethylammonium methylsulfate meditated transformation, and others. Further a large variety of nucleic acid tools are available from many different sources including ATCC, and various commercial sources. One skilled in the art will be readily able to select the appropriate tools and methods for genetic modifications of any particular virus according to the knowledge in the art and design choice.

Any of a variety of modifications can be readily accomplished using standard molecular biological methods known in the art. The modifications will typically be one or more truncations, deletions, mutations or insertions of the viral genome. In one embodiment, the modification can be specifically directed to a particular sequence. The modifications can be directed to any of a variety of regions of the viral genome, including, but not limited to, a regulatory sequence, to a gene-encoding sequence, or to a sequence without a known role. Any of a variety of regions of viral genomes that are available for modification are readily known in the art for many viruses, including the viruses specifically listed herein. As a non-limiting example, the loci of a variety of vaccinia genes provided herein and elsewhere exemplify the number of different regions that can be targeted for modification in the viruses provided herein. In another embodiment, the modification can be fully or partially random, whereupon selection of any particular modified virus can be determined according to the desired properties of the modified the virus. These methods include, for example, in vitro recombination techniques, synthetic methods and in vivo recombination methods as described, for example, in Sambrook et al., *Molecular Cloning: A Laboratory Manual,* 2nd edition, Cold Spring Harbor Laboratory Press, cold Spring Harbor N.Y. (1989), and in the Examples disclosed herein.

In some embodiments, the virus can be modified to express an exogenous gene. Exemplary exogenous gene products include proteins and RNA molecules. The modified viruses can express a detectable gene product, a therapeutic gene product, a gene product for manufacturing or harvesting, or an antigenic gene product for antibody harvesting. The characteristics of such gene products are described herein and elsewhere. In some embodiments of modifying an organism to express an exogenous gene, the modification can also contain one or more regulatory sequences to regulate expression of the exogenous gene. As is known in the art, regulatory sequences can permit constitutive expression of the exogenous gene or can permit inducible expression of the exogenous gene. Further, the regulatory sequence can permit control of the level of expression of the exogenous gene. In some examples, inducible expression can be under the control of cellular or other factors present in a tumor cell or present in a virus-infected tumor cell. In other examples, inducible expression can be under the control of an administrable substance, including IPTG, RU486 or other known induction compounds. Any of a variety of regulatory sequences are available to one skilled in the art according to known factors and design preferences. In some embodiments, such as gene product manufacture and harvesting, the regulatory sequence can result in constitutive, high levels of gene expression. In some embodiments, such as anti-(gene product) antibody harvesting, the regulatory sequence can result in constitutive, lower levels of gene expression. In tumor therapy embodiments, a therapeutic protein can be under the control of an internally inducible promoter or an externally inducible promoter.

In other embodiments, organ or tissue-specific expression can be controlled by regulatory sequences. In order to achieve expression only in the target organ, for example, a tumor to be treated, the foreign nucleotide sequence can be linked to a tissue specific promoter and used for gene therapy. Such promoters are well known to those skilled in the art (see e.g., Zimmermann et al., *Neuron* 12: 11-24 (1994); Vidal et al., *EMBO J.* 9: 833-840 (1990); Mayford et al., *Cell* 81: 891-904 (1995); and Pinkert et al., *Genes & Dev.* 1: 268-76 (1987)).

In some embodiments, the viruses can be modified to express two or more proteins, where any combination of the two or more proteins can be one or more detectable gene products, therapeutic gene products, gene products for manufacturing or harvesting or antigenic gene products for antibody harvesting. In one embodiment, a virus can be modified to express a detectable protein and a therapeutic protein. In another embodiment, a virus can be modified to express two or more gene products for detection or two or more therapeutic gene products. For example, one or more proteins involved in biosynthesis of a luciferase substrate can be expressed along with luciferase. When two or more exogenous genes are introduced, the genes can be regulated under the same or different regulatory sequences, and the genes can be inserted in the same or different regions of the viral genome, in a single or a plurality of genetic manipulation steps. In some embodiments, one gene, such as a gene encoding a detectable gene product, can be under the control of a constitutive promoter, while a second gene, such as a gene encoding a therapeutic gene product, can be under the control of an inducible promoter. Methods for inserting two or more genes in to a virus are known in the art and can be readily performed for a wide variety of viruses using a wide variety of exogenous genes, regulatory sequences, and/or other nucleic acid sequences.

Methods of producing recombinant viruses are known in the art. Provided herein for exemplary purposes are methods of producing a recombinant vaccinia virus. A recombinant vaccinia virus with an insertion in the F14.5L gene (NotI site of LIVP) can be prepared by the following steps: (a) generating (i) a vaccinia shuttle plasmid containing the modified F14.5L gene inserted at restriction site X and (ii) a dephosphorylated wt VV (VGL) DNA digested at restriction site X; (b) transfecting host cells infected with PUV-inactivated helper VV (VGL) with a mixture of the constructs of (i) and (ii) of step a; and (c) isolating the recombinant vaccinia viruses from the transfectants. One skilled in the art knows how to perform such methods, for example by following the instructions given in co-pending U.S. application Ser. Nos. 10/872,156 and 11/238,025; see also Timiryasova et al. (*Biotechniques* 31: 534-540 (2001)). In one embodiment, restriction site X is a unique restriction site. A variety of suitable host cells also are known to the person skilled in the art and include many mammalian, avian and insect cells and tissues which are susceptible for vaccinia virus infection, including chicken embryo, rabbit, hamster and monkey kidney cells, for example, HeLa cells, $RK_{13}$, CV-1, Vero, BSC40 and BSC-1 monkey kidney cells.

2. Screening of Modified Viruses

Modified viruses can be screened for any desired characteristics, including the characteristics described herein such as attenuated pathogenicity, reduced toxicity, preferential accumulation in tumor, increased ability to activate an immune response against tumor cells, increased immunogenicity, increased or decreased replication competence, and are able to express exogenous proteins, and combinations thereof. For example, the modified viruses can be screened for the ability to activate an immune response against tumor cells without aggressively killing the tumor cells. In another example, the viruses can be screened for expression of one or more detectable genes, including genes that can be used for imaging, or for expression of one or more genes for manufacture or harvest of the gene products and/or for harvest of antibodies against the gene products.

Any of a variety of known methods for screening for such characteristics can be performed, as demonstrated in the Examples provided herein. One exemplary method for screening for desired characteristics includes, but is not limited to, monitoring growth, replication and/or gene expression (including expression of an exogenous gene) in cell culture or other in vitro medium. The cell culture can be from any organism, and from any tissue source, and can include tumorous tissues. Other exemplary methods for screening for desired characteristics include, but are not limited to, administering a virus to animal, including non-human animals such as a mouse, monkey or ape, and optionally also including humans, and monitoring the virus, the tumor, and or the animal; monitoring can be performed by in vivo imaging of the virus and/or the tumor (e.g., low light imaging of viral gene expression or ultrasonic tumor imaging), external monitoring of the tumor (e.g., external measurement of tumor size), monitoring the animal (e.g., monitoring animal weight, blood panel, antibody titer, spleen size, or liver size). Other exemplary methods for screening for desired characteristics include, but are not limited to, harvesting a non-human animal for the effects and location of the virus and expression by the virus, including methods such as harvesting a variety of organs including a tumor to determine presence of the virus and/or gene expression by the virus in the organs or tumor, harvesting of organs associated with an immune response or viral clearance such as the spleen or liver, harvesting the tumor to determine tumor size and viability of tumor cells, harvesting antibodies or antibody producing cells. Such screening and monitoring methods can be used in any of a variety of combinations, as is known in art. In one embodiment, a virus can be screened by administering the virus to an animal such as a non-human animal or a human, followed by monitoring by in vivo imaging. In another embodiment, a virus can be screened by administering the virus to an animal such as a non-human animal, monitoring by in vivo imaging, and then harvesting the animal. Thus, provided herein are methods for screening a virus for desired characteristics by administering the virus to an animal such as an animal with a tumor, and monitoring the animal, tumor (if present), and/or virus in the animal for one or more characteristics. Also provided herein are methods for screening a virus for desired characteristics by administering the virus to a non-human animal such as a non-human animal with a tumor, harvesting the animal, and assaying the animal's organs, antibody titer, and/or tumor (if present) for one or more characteristics.

Provided herein are methods for screening a virus for attenuated pathogenicity or reduced toxicity, where the pathogenicity or toxicity can be determined by a variety of techniques, including, but not limited to, assessing the health state of the subject, measuring the body weight of a subject, blood or urine analysis of a subject, and monitoring tissue distribution of the virus within the subject; such techniques can be performed on a living subject in vivo, or can be performed post mortem. Methods also can include the ability of the viruses to lyse cells or cause cell death, which can be determined in vivo or in vitro.

When a subject drops below a threshold body weight, the virus can be considered pathogenic to the subject. Exemplary thresholds can be a drop of about 5% or more, a drop of about 10% or more, or a drop of about 15% or more in body weight relative to a reference. A body weight reference can be selected from any of a variety of references used in the art; for example, a body weight reference can be the weight of the subject prior to administration of the virus, the body weight reference can be a control subject having the same condition as the test subject (e.g., normal or tumor-injected), where the change in weight of the control is compared to the change in weight of the test subject for the time period after administration of the virus.

Blood or urine analysis of the subject can indicate level of immune response, level of toxins in the subject, or other levels of stress to cells, tissues or organs of the subject such as kidneys, pancreas, liver and spleen. Levels increased above established threshold levels can indicate pathogenicity of the virus to the subject. Threshold levels of components of blood or urine for indicating viral pathogenicity are well known in the art, and any such thresholds can be selected herein according to the desired tolerance of pathogenicity or toxicity of the virus.

Tissue distribution of a virus in a subject can indicate pathogenicity or toxicity of the virus. In one embodiment, tissue distribution of a virus that is not pathogenic or toxic can be mostly in tumor relative to other tissues or organs. Microorganisms located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the viruses accumulate in any other particular organ or tissue.

Provided herein are methods for screening a virus for tissue distribution or accumulation, where the tissue distribution can be determined by a variety of techniques, including, but not limited to, harvesting a non-human subject, in vivo imaging a detectable gene product in subject. Harvesting can be accomplished by euthanizing the non-human subject, and determining the accumulation of viruses in tumor and, optionally, the accumulation in one or more additional tissues or organs. The accumulation can be determined by any of a variety of methods, including, but not limited to, detecting gene products such as detectable gene products (e.g., GFP or beta galactosidase), histological or microscopic evaluation of tissue, organ or tumor samples, or measuring the number of plaque or colony forming units present in a tissue, organ or tumor sample. In one embodiment, the desired amount of tissue distribution of a virus can be mostly in tumor relative to other tissues or organs. Microorganisms located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the viruses accumulate in any other particular organ or tissue.

Also provided herein are methods of screening for viruses that can elicit an immune response, where the immune response can be against the tumor cells or against the viruses. A variety of methods for measuring the ability to elicit an immune response are known in the art, and include measuring an overall increase in immune activity in a subject, measuring an increase in anti-virus or anti-tumor antibodies in a subject, testing the ability of a virus-treated (typically a non-human) subject to prevent later infection/tumor formation or to rapidly eliminate viruses or tumor cells. Methods also can include the ability of the viruses to lyse cells or cause cell death, which can be determined in vivo or in vitro.

Also provided herein are methods for determining increased or decreased replication competence, by monitoring the speed of replication of the viruses. Such measurements can be performed in vivo or in vitro. For example, the speed of replication in a cell culture can be used to determine replication competence of a virus. In another example, the speed of replication in a tissue, organ or tumor in a subject can be used to measure replication competence. In some embodiments, decreased replication competence in non-tumor tissues and organs can be the characteristic to be selected in a screen. In other embodiments, increased replication competence in tumors can be the characteristic to be selected in a screen.

Also provided herein are methods for determining the ability of a virus to express genes, such as exogenous genes. Such methods can be performed in vivo or in vitro. For example, the viruses can be screened on selective plates for the ability to express a gene that permits survival of the virus or permits the virus to provide a detectable signal, such as turning X-gal blue. Such methods also can be performed in vivo, where expression can be determined, for example, by harvesting tissues, organs or tumors in a non-human subject or by in vivo imaging of a subject.

Also provided herein are methods for determining the ability of a virus to express genes toward which the subject can develop antibodies, including exogenous genes toward which the subject can develop antibodies. Such methods can be performed in vivo using any of a variety of non-human subjects. For example, gene expression can be determined, for example, by bleeding a non-human subject to which a virus has been administered, and assaying the blood (or serum) for the presence of antibodies against the virus-expressed gene, or by any other method generally used for polyclonal antibody harvesting, such as production bleeds and terminal bleeds.

Also provided herein are methods for screening a virus that has two or more characteristics provided herein, including screening for attenuated pathogenicity, reduced toxicity, preferential accumulation in tumor, increased ability to activate an immune response against tumor cells, increased immunogenicity, increased or decreased replication competence, ability to express exogenous proteins, and ability to elicit antibody production against a virally expressed gene product. A single monitoring technique, such as in vivo imaging, can be used to verify two or more characteristics, or a variety of different monitoring techniques can be used, as can be determined by one skilled in the art according to the selected characteristics and according to the monitoring techniques used.

Mouse models of different types of human and non-human animal cancers can be employed to assess the properties of the modified viruses. Tumors can be established by implantation of different tumor cell types. Exemplary human tumor xenograft models in mice include, but are not limited to, human lung carcinoma (A549 cells, ATCC No. CCL-185); humanbreast tumor (GI-101A cells, Rathinavelu et al., *Cancer Biochem*. Biophys., 17:133-146 (1999)); human ovarian carcinoma (OVCAR-3 cells, ATCC No. HTB-161); human pancreatic carcinoma (PANC-1 cells, ATCC No. CRL-1469 and MIA PaCa-2 cells, ATCC No. CRL-1420); DU145 cells (human prostate cancer cells, ATCC No. HTB-81); human prostate cancer (PC-3 cells, ATCC# CRL-1435); colon carcinoma (HT-29 cells); human melanoma (888-MEL cells, 1858-MEL cells or 1936-MEL cells; see e.g. Wang et al., (2006) *J. Invest. Dermatol.* 126:1372-1377); and human fibrosarcoma (HT-1080 cells, ATCC No. CCL-121). Exemplary rat tumor xenograft models in mice include, but are not limited to, glioma tumor (C6 cells; ATCC No. CCL-107). Exemplary mouse tumor homograft models include, but are not limited to, mouse melanoma (B16-F10 cells; ATCC No. CRL-6475). Exemplary cat tumor xenograft models in mice include, but are not limited to, feline fibrosarcoma (FC77.T cells; ATCC No. CRL-6105). Exemplary dog tumor xenograft models in mice include, but are not limited to, canine osteosarcoma (D17 cells; ATCC No. CCL-183).

E. EXEMPLARY CHARACTERISTICS OF THE VIRUSES PROVIDED

The viruses provided herein can accumulate in immunoprivileged cells or immunoprivileged tissues, including tumors and/or metastases, and also including wounded tissues and cells. While the viruses provided herein can typically be cleared from the subject to whom the viruses are administered by activity of the subject's immune system, viruses can nevertheless accumulate, survive and proliferate in immunoprivileged cells and tissues such as tumors because such immunoprivileged areas are sequestered from the host's immune system. Accordingly, the methods provided herein, as applied to tumors and/or metastases, and therapeutic methods relating thereto, can readily be applied to other immunoprivileged cells and tissues, including wounded cells and tissues.

1. Attenuated

The viruses provided herein and viruses provided for use in the methods are typically attenuated. Attenuated viruses have a decreased capacity to cause disease in a host. The decreased capacity can result from any of a variety of different modifications to the ability of a virus to be pathogenic. For example, a virus can have reduced toxicity, reduced ability to accumulate in non-tumorous organs or tissue, reduced ability to cause cell lysis or cell death, or reduced ability to replicate compared to the non-attenuated form thereof. The attenuated viruses provided herein, however, retain at least some capacity to replicate and to cause immunoprivileged cells and tissues, such as tumor cells to leak or lyse, undergo cell death, or otherwise cause or enhance an immune response to immunoprivileged cells and tissues, such as tumor cells.

a. Reduced Toxicity

Viruses can be toxic to their hosts by manufacturing one or more compounds that worsen the health condition of the host. Toxicity to the host can be manifested in any of a variety of manners, including septic shock, neurological effects or muscular effects. The viruses provided herein can have a reduced toxicity to the host. The reduced toxicity of a virus of the present methods and compositions can range from a toxicity in which the host experiences no toxic effects, to a toxicity in which the host does not typically die from the toxic effects of the microbes. In some embodiments, the viruses are of a reduced toxicity such that a host typically has no significant long-term effect from the presence of the viruses in the host, beyond any effect on tumorous, metastatic or necrotic organs or tissues. For example, the reduced toxicity can be a minor fever or minor infection, which lasts for less than about a month, and following the fever or infection, the host experiences no adverse effects resultant from the fever or infection. In another example, the reduced toxicity can be measured as an unintentional decline in body weight of about 5% or less for the host after administration of the microbes. In other examples, the virus has no toxicity to the host.

b. Accumulate in Tumor, not Substantially in Other Organs

Viruses can accumulate in any of a variety of tissues and organs of the host. Accumulation can be evenly distributed over the entire host organism, or can be concentrated in one or a few organs or tissues. The viruses provided herein can accumulate in targeted tissues, such as immunoprivileged cells and tissues, such as tumors and also metastases. In some embodiments, the viruses provided herein exhibit accumulation in immunoprivileged cells and tissues, such as tumor cells relative to normal organs or tissues that is equal to or greater than the accumulation that occurs with wild-type viruses. In other embodiments, the viruses provided herein exhibit accumulation in immunoprivileged cells and tissues, such as tumor cells that is equal to or greater than the accumulation in any other particular organ or tissue. For example, the viruses provided herein can demonstrate an accumulation in immunoprivileged cells and tissues, such as tumor cells that is at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the accumulation in any other particular organ or tissue.

In some embodiments, a virus can accumulate in targeted tissues and cells, such as immunoprivileged cells and tissues, such as tumor cells, without accumulating in one or more selected tissues or organs. For example, a virus can accumulate in tumor cells without accumulating in the brain. In another example, a virus can accumulate in tumor cells without accumulating in neural cells. In another example, a virus can accumulate in tumor cells without accumulating in ovaries. In another example, a virus can accumulate in tumor cells without accumulating in the blood. In another example, a virus can accumulate in tumor cells without accumulating in the heart. In another example, a virus can accumulate in tumor cells without accumulating in the bladder. In another example, a virus can accumulate in tumor cells without accumulating in testes. In another example, a virus can accumulate in tumor cells without accumulating in the spleen. In another example, a virus can accumulate in tumor cells without accumulating in the lungs.

One skilled in the art can determine the desired capability for the viruses to selectively accumulate in targeted tissue or cells, such as in an immunoprivileged cells and tissues, such as tumor rather than non-target organs or tissues, according to a variety of factors known in the art, including, but not limited to, toxicity of the viruses, dosage, tumor to be treated, immunocompetence of host, and disease state of the host.

c. Ability to Elicit or Enhance Immune Response to Tumor Cells

Viruses herein can cause or enhance an immune response to antigens in the targeted tissues or cells, such as immunoprivileged cells and tissues, such as tumor cells. The immune response can be triggered by any of a variety of mechanisms, including the presence or expression of immunostimulatory cytokines and the expression or release of antigenic compounds that can cause an immune response.

Cells, in response to an infection such as a viral infection, can send out signals to stimulate an immune response against the cells. Exemplary signals sent from such cells include antigens, cytokines and chemokines such as interferon-gamma and interleukin-15. The viruses provided herein can cause targeted cells to send out such signals in response to infection by the microbes, resulting in a stimulation of the host's immune system against the targeted cells or tissues, such as tumor cells.

In another embodiment, targeted cells or tissues, such as tumor cells, can contain one or more compounds that can be recognized by the host's immune system in mounting an immune response against a tumor. Such antigenic compounds can be compounds on the cell surface or the tumor cell, and can be protein, carbohydrate, lipid, nucleic acid or combinations thereof. Viral-mediated release of antigenic compounds can result in triggering the host's immune system to mount an immune response against the tumor. The amount of antigenic compound released by the tumor cells is any amount sufficient to trigger an immune response in a subject; for example, the antigenic compounds released from one or more tumor cells can trigger a host immune response in the organism that is known to be accessible to leukocytes.

The time duration of antigen release is an amount of time sufficient for the host to establish an immune response to one or more tumor antigens. In some embodiments, the duration is an amount of time sufficient for the host to establish a sustained immune response to one or more tumor antigens. One skilled in the art can determine such a time duration based on a variety of factors affecting the time duration for a subject to develop an immune response, including the level of the tumor antigen in the subject, the number of different tumor antigens, the antigenicity of the antigen, the immunocompetence of the host, and the access of the antigenic material to the vasculature of the host. Typically, the duration of antigen release can be at least about a week, at least about 10 days, at least about two weeks, or at least about a month.

The viruses provided herein can have any of a variety of properties that can cause target cells and tissues, such as tumor cells, to release antigenic compounds. Exemplary properties are the ability to lyse cells and the ability to elicit apoptosis in tumor cells. Viruses that are unable to lyse tumor cells or cause tumor cell death can nevertheless be used in the methods provided herein when such viruses can cause some release or display of antigenic compounds from tumor cells. A variety of mechanisms for antigen release or display without lysis or cell death are known in the art, and any such mechanism can be used by the viruses provided herein, including, but not limited to, secretion of antigenic compounds, enhanced cell membrane permeability, expression of immunostimulatory proteins or altered cell surface expression or altered MHC presentation in tumor cells when the tumor cells can be accessed by the host's immune system. Regardless of the mechanism by which the host's immune system is activated, the net result of the presence of the viruses in the tumor is a stimulation of the host's immune system, at least in part, against the tumor cells. In one example, the viruses can cause an immune response against tumor cells not infected by the viruses.

In one embodiment, the viruses provided herein can cause tumor cells to release an antigen that is not present on the tumor cell surface. Tumor cells can produce compounds such as proteins that can cause an immune response; however, in circumstances in which the antigenic compound is not on the tumor cell surface, the tumor can proliferate, and even metastasize, without the antigenic compound causing an immune response. Within the scope of the present methods, the viruses provided herein can cause antigenic compounds within the cell to release away from the cell and away from the tumor, which can result in triggering an immune response to such an antigen. Even if not all cells of a tumor are releasing antigens, the immune response can initially be targeted toward the "leaky" tumor cells, and the bystander effect of the immune response can result in further tumor cell death around the "leaky" tumor cells.

d. Balance of Pathogenicity and Release of Tumor Antigens

Typical methods of involving treatment of targeted cells and tissues, such as immunoprivileged cells and tissues, such as tumors, are designed to cause rapid and complete removal thereof. For example, many viruses can cause lysis and/or apoptosis in a variety of cells, including tumor cells. Viruses that can vigorously lyse or cause cell death can be highly pathogenic, and can even kill the host. Furthermore, therapeutic methods based upon such rapid and complete lysis are typically therapeutically ineffective.

In contrast, the viruses provided herein are not aggressive in causing cell death or lysis. They can have a limited or no ability to cause cell death as long as they accumulate in the target cells or tissues and result in alteration of cell membranes to cause leakage of antigens against which an immune response is mounted. It is desirable that their apoptotic or lytic effect is sufficiently slow or ineffective to permit sufficient antigenic leakage for a sufficient time for the host to mount an effective immune response against the target tissues. Such immune response alone or in combination with the lytic/apoptotic effect of the virus results in elimination of the target tissue and also elimination of future development, such as metastases and reoccurrence, of such tissues or cells. While the viruses provided herein can have a limited ability to cause cell death, the viruses provided herein can nevertheless stimulate the host's immune system to attack tumor cells. As a result, such viruses also are typically unlikely to have substantial toxicity to the host.

In one embodiment, the viruses have a limited, or no ability to cause tumor cell death, while still causing or enhancing an immune response against tumor cells. In one example, the rate of viral-mediated tumor cell death is less than the rate of tumor cell growth or replication. In another example, the rate of viral-mediated tumor cell death is slow enough for the host to establish a sustained immune response to one or more tumor antigens. Typically, the time for cell death is sufficient to establish an anti-tumor immune response and can be at least about a week, at least about 10 days, at least about two weeks, or at least about a month, depending upon the host and the targeted cells or tissues.

In another embodiment, the viruses provided herein can cause cell death in tumor cells, without causing substantial cell death in non-tumor tissues. In such an embodiment, the viruses can aggressively kill tumor cells, as long as no substantial cell death occurs in non-tumor cells, and optionally, so long as the host has sufficient capability to mount an immune response against the tumor cells.

In one embodiment, the ability of the viruses to cause cell death is slower than the host's immune response against the viruses. The ability for the host to control infection by the viruses can be determined by the immune response (e.g., antibody titer) against viral antigens. Typically, after the host has mounted immune response against the viruses, the viruses can have reduced pathogenicity in the host. Thus, when the ability of the viruses to cause cell death is slower than the host's immune response against the microbes, viral-mediated cell death can occur without risk of serious disease or death to the host. In one example, the ability of the viruses to cause tumor cell death is slower than the host's immune response against the microbes.

2. Immunogenicity

The viruses provided herein also can be immunogenic. An immunogenic virus can create a host immune response against the virus. In one embodiment, the viruses can be sufficiently immunogenic to result in a large anti-viral antibody titer. The viruses provided herein can have the ability to elicit an immune response. The immune response can be activated in response to viral antigens or can be activated as a result of viral-infection induced cytokine or chemokine production. Immune response against the viruses can decrease the likelihood of pathogenicity toward the host organism.

Immune response against the viruses also can result in target tissue or cell, such as tumor cell, killing. In one embodiment, the immune response against viral infection can result in an immune response against tumor cells, including developing antibodies against tumor antigens. In one example, an immune response mounted against the virus can result in tumor cell killing by the "bystander effect," where uninfected tumor cells nearby infected tumor cells are killed at the same time as infected cells, or alternatively, where uninfected tumor cells nearby extracellular viruses are killed at the same time as the viruses. As a result of bystander effect tumor cell death, tumor cell antigens can be released from cells, and the host organism's immune system can mount an immune response against tumor cell antigens, resulting in an immune response against the tumor itself.

In one embodiment, the virus can be selected or modified to express one or more antigenic compounds, including superantigenic compounds. The antigenic compounds such as superantigens can be endogenous gene products or can be exogenous gene products. Superantigens, including toxoids, are known in the art and described elsewhere herein.

3. Replication Competent

The viruses provided herein can be replication competent. In a variety of viral systems, the administered virus is rendered replication incompetent to limit pathogenicity risk to the host. While replication incompetence can protect the host from the virus, it also limits the ability of the virus to infect and kill tumor cells, and typically results in only a short-lived effect. In contrast, the viruses provided herein can be attenuated but replication competent, resulting in low toxicity to the host and accumulation mainly or solely in tumors. Thus, the viruses provided herein can be replication competent without creating a pathogenicity risk to the host.

Attenuation of the viruses provided herein can include, but is not limited to, reducing the replication competence of the virus. For example, a virus can be modified to decrease or eliminate an activity related to replication, such as a transcriptional activator that regulates replication in the virus. In an example, a virus, can have the viral thymidine kinase (TK) gene modified, which decreases replication of the virus.

4. Genetic Variants

The viruses provided herein can be modified from their wild type form. Modifications can include any of a variety of changes, and typically include changes to the genome or nucleic acid molecules of the viruses. Exemplary nucleic acid molecular modifications include truncations, insertions, deletions and mutations. In an exemplary modification, a viral gene can be modified by truncation, insertion, deletion or mutation. In an exemplary insertion, an exogenous gene can be inserted into the genome of the virus.

Modifications of the viruses provided herein can result in a modification of viral characteristics, including those provided herein such as pathogenicity, toxicity, ability to preferentially accumulate in tumor, ability to lyse cells or cause cell death, ability to elicit an immune response against tumor cells, immunogenicity and replication competence. Variants can be obtained by general methods such as mutagenesis and passage in cell or tissue culture and selection of desired properties, as is known in the art, as exemplified for respiratory syncytial virus in Murphy et al., *Virus Res.* 1994, 32:13-26.

Variants also can be obtained by mutagenic methods in which nucleic acid residues of the virus are added, removed or modified relative to the wild type. Any of a variety of known mutagenic methods can be used, including recombination-based methods, restriction endonuclease-based methods, and PCR-based methods. Mutagenic methods can be directed against particular nucleotide sequences such as genes, or can be random, where selection methods based on desired characteristics can be used to select mutated viruses. Any of a variety of viral modifications can be made, according to the selected virus and the particular known modifications of the selected virus.

F. PHARMACEUTICAL COMPOSITIONS, COMBINATIONS AND KITS

Provided herein are pharmaceutical compositions, combinations and kits containing a virus provided herein and one or more components. Pharmaceutical compositions can include a virus provided herein and a pharmaceutical carrier. Combinations can include two or more viruses, a virus and a detectable compound, a virus and a viral expression modulating compound, a virus and a therapeutic compound, or any combination thereof. Kits can include the pharmaceutical compositions and/or combinations provided herein, and one or more components, such as instructions for use, a device for detecting a virus in a subject, a device for administering a compound to a subject and a device for administering a compound to a subject.

1. Pharmaceutical Compositions

Provided herein are pharmaceutical compositions containing a virus provided herein and a suitable pharmaceutical carrier. Pharmaceutical compositions provided herein can be in various forms, e.g., in solid, liquid, powder, aqueous, or lyophilized form. Examples of suitable pharmaceutical carriers are known in the art and include but are not limited to water, buffers, saline solutions, phosphate buffered saline solutions, various types of wetting agents, sterile solutions, alcohols, gum arabic, vegetable oils, benzyl alcohols, gelatin, glycerin, carbohydrates such as lactose, sucrose, amylose or starch, magnesium stearate, talc, silicic acid, viscous paraffin, perfume oil, fatty acid monoglycerides and diglycerides, pentaerythritol fatty acid esters, hydroxy methylcellulose, powders, among others. Pharmaceutical compositions provided herein can contain other additives including, for example, antioxidants and preservatives, analgesic agents, binders, disintegrants, coloring, diluents, exipients, extenders, glidants, solubilizers, stabilizers, tonicity agents, vehicles, viscosity agents, flavoring agents, emulsions, such as oil/water emulsions, emulsifying and suspending agents, such as acacia, agar, alginic acid, sodium alginate, bentonite, carbomer, carrageenan, carboxymethylcellulose, cellulose, cholesterol, gelatin, hydroxyethyl cellulose, hydroxypropyl cellulose, hydroxypropyl methylcellulose, methylcellulose, octoxynol 9, oleyl alcohol, povidone, propylene glycol monostearate, sodium lauryl sulfate, sorbitan esters, stearyl alcohol, tragacanth, xanthan gum, and derivatives thereof, solvents, and miscellaneous ingredients such as crystalline cellulose, microcrystalline cellulose, citric acid, dextrin, dextrose, liquid glucose, lactic acid, lactose, magnesium chloride, potassium metaphosphate, starch, among others. Such carriers and/or additives can be formulated by conventional methods and can be administered to the subject at a suitable dose. Stabilizing agents such as lipids, nuclease inhibitors, polymers, and chelating agents can preserve the compositions from degradation within the body.

Colloidal dispersion systems that can be used for delivery of viruses include macromolecule complexes, nanocapsules, microspheres, beads and lipid-based systems including oil-in-water emulsions (mixed), micelles, liposomes and lipoplexes. An exemplary colloidal system is a liposome. Organ-specific or cell-specific liposomes can be used in order to achieve delivery only to the desired tissue. The targeting of liposomes can be carried out by the person skilled in the art by applying commonly known methods. This targeting includes passive targeting (utilizing the natural tendency of the liposomes to distribute to cells of the RES in organs which contain sinusoidal capillaries) or active targeting (for example, by coupling the liposome to a specific ligand, for example, an antibody, a receptor, sugar, glycolipid and protein by methods know to those of skill in the art). In the present methods, monoclonal antibodies can be used to target liposomes to specific tissues, for example, tumor tissue, via specific cell-surface ligands.

2. Host Cells

Also provided herein are host cells that contain a virus provided herein, such as a modified vaccinia virus. Such cells can be a group of a single type of cells or a mixture of different types of cells. Host cells can include cultured cell lines, primary cells and proliferative cells. These host cells can include any of a variety of animal cells, such as mammalian, avian and insect cells and tissues that are susceptible to the virus, such as vaccinia virus, infection, including chicken embryo, rabbit, hamster and monkey kidney cells. Suitable host cells include but are not limited to hematopoietic cells (totipotent, stem cells, leukocytes, lymphocytes, monocytes, macrophages, APC, dendritic cells, non-human cells and the like), pulmonary cells, tracheal cells, hepatic cells, epithelial cells, endothelial cells, muscle cells (e.g., skeletal muscle, cardiac muscle or smooth muscle), fibroblasts, and cell lines including, for example, CV-1, BSC40, Vero, BSC40 and BSC-1, and human HeLa cells. Methods for transforming these host cells, phenotypically selecting transformants, and other such methods are known in the art.

3. Combinations

Provided are combinations of the viruses provided herein and a second agent, such as a second virus or other therapeutic or diagnostic agent. A combination can include any virus or reagent for effecting attenuation thereof in accord with the methods provided herein. Combinations can include a virus provided herein with one or more additional viruses. Combinations of the viruses provided can also contain pharmaceutical compositions containing the viruses or host cells containing the viruses as described herein.

In one embodiment, the virus in a combination is an attenuated virus, such as for example, an attenuated vaccinia virus. Exemplary attenuated viruses include vaccinia viruses provided herein, such as, but not limited to, for example, vaccinia viruses described in the Examples: GLV-1h86, GLV-1j87, GLV-1j88, GLV-1j89, GLV-1h90, GLV-1h91, GLV-1h92, GLV-1h96, GLV-1h97, GLV-1h98, GLV-1h104, GLV-1h105, GLV-1h106, GLV-1h107, GLV-1h108 and GLV-1h109.

Combinations provided herein can contain a virus and a therapeutic compound. Therapeutic compounds for the compositions provided herein can be, for example, an anti-cancer or chemotherapeutic compound. Exemplary therapeutic compounds include, for example, cytokines, growth factors, photosensitizing agents, radionuclides, toxins, siRNA molecules, enzyme/pro-drug pairs, anti-metabolites, signaling modulators, anti-cancer antibiotics, anti-cancer antibodies, angiogenesis inhibitors, chemotherapeutic compounds or a combination thereof. Viruses provided herein can be combined with an anti-cancer compound, such as a platinum coordination complex. Exemplary platinum coordination complexes include, for example, cisplatin, carboplatin, oxaliplatin, DWA2114R, NK121, IS 3 295, and 254-S. Additional exemplary therapeutic compounds for the use in pharmaceutical composition combinations can be found elsewhere herein (see e.g., Section I. THERAPEUTIC METHODS for exemplary cytokines, growth factors, photosensitizing agents, radionuclides, toxins, siRNA molecules, enzyme/pro-drug pairs, anti-metabolites, signaling modulators, anti-cancer antibiotics, anti-cancer antibodies, angiogenesis inhibitors, and chemotherapeutic compounds). Exemplary chemotherapeutic agents include methotrexate, vincristine, adriamycin, non-sugar containing chloroethylnitrosoureas, 5-fluorouracil, mitomycin C, bleomycin, doxorubicin, dacarbazine, taxol, fragyline, Meglamine GLA, valrubicin, carmustaine and poliferposan, MM1270, BAY 12-9566, RAS farnesyl transferase inhibitor, farnesyl transferase inhibitor, MMP, MTA/LY231514, LY264618/Lometexol, Glamolec, CI-994, TNP-470, Hycamtin/Topotecan, PKC412, Valspodar/PSC833, Novantrone/Mitroxantrone, Metaret/Suramin, Batimastat, E7070, BCH-4556, CS-682, 9-AC, AG3340, AG3433, Incel/VX-710, VX-853, ZD0101, IS1641, ODN 698, TA 2516/Marmistat, BB2516/Marmistat, CDP 845, D2163, PD183805, DX8951f, Lemonal DP 2202, FK 317, Picibanil/OK-432, AD 32Nalrubicin, Metastron/strontium derivative, Temodal/Temozolomide, Evacet/liposomal doxorubicin, Yewtaxan/Placlitaxel, Taxol/Paclitaxel, Xeload/Capecitabine, Furtulon/Doxifluridine, Cyclopax/oral paclitaxel, Oral Taxoid, SPU-077/Cisplatin, HMR 1275/Flavopiridol, CP-358 (774)/EGFR, CP-609 (754)/RAS oncogene inhibitor, BMS-182751/oral platinum, UFT (Tegafur/Uracil), Ergamisol/Levamisole, Eniluracil/776C85/5FU enhancer, Campto/Levamisole, Camptosar/Irinotecan, Tumodex/Ralitrexed, Leustatin/Cladribine, Paxex/Paclitaxel, Doxil/liposomal doxorubicin, Caelyx/liposomal doxorubicin, Fludara/Fludarabine, Pharmarubicin/Epirubicin, DepoCyt, ZD1839, LU 79553/Bis-Naphtalimide, LU 103793/Dolastain, Caetyx/liposomal doxorubicin, Gemzar/

Gemcitabine, ZD 0473/Anormed, YM 116, Iodine seeds, CDK4 and CDK2 inhibitors, PARP inhibitors, D4809/Dexifosamide, Ifes/Mesnex/Ifosamide, Vumon/Teniposide, Paraplatin/Carboplatin, Plantinol/cisplatin, Vepeside/Etoposide, ZD 9331, Taxotere/Docetaxel, prodrug of guanine arabinoside, Taxane Analog, nitrosoureas, alkylating agents such as melphelan and cyclophosphamide, Aminoglutethimide, Asparaginase, Busulfan, Carboplatin, Chlorombucil, Cytarabine HCl, Dactinomycin, Daunorubicin HCl, Estramustine phosphate sodium, Etoposide (VP16-213), Floxuridine, Fluorouracil (5-FU), Flutamide, Hydroxyurea (hydroxycarbamide), Ifosfamide, Interferon Alfa-2a, Alfa-2b, Leuprolide acetate (LHRH-releasing factor analogue), Lomustine (CCNU), Mechlorethamine HCl (nitrogen mustard), Mercaptopurine, Mesna, Mitotane (o.p'-DDD), Mitoxantrone HCl, Octreotide, Plicamycin, Procarbazine HCl, Streptozocin, Tamoxifen citrate, Thioguanine, Thiotepa, Vinblastine sulfate, Amsacrine (m-AMSA), Azacitidine, Erythropoietin, Hexamethylmelamine (HMM), Interleukin 2, Mitoguazone (methyl-GAG; methyl glyoxal bis-guanylhydrazone; MGBG), Pentostatin (2'deoxycoformycin), Semustine (methyl-CCNU), Teniposide (VM-26) and Vindesine sulfate.

In a further embodiment, the combination can include additional therapeutic compounds such as, for example, compounds that are substrates for enzymes encoded and expressed by the virus, or other therapeutic compounds provided herein or known in the art to act in concert with a virus. For example, the virus can express an enzyme that converts a prodrug into an active chemotherapy drug for killing the cancer cell. Hence, combinations provided herein can contain therapeutic compounds, such as prodrugs. An exemplary virus/therapeutic compound combination can include a virus encoding Herpes simplex virus thymidine kinase with the prodrug gancyclovir. Additional exemplary enzyme/pro-drug pairs, for the use in combinations provided include, but are not limited to, varicella zoster thymidine kinase/gancyclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl)(2 mesyloxyethyl)amino]benzoyl-L-glutamic acid, cytochrome P450/acetominophen, horseradish peroxidase/indole-3-acetic acid, nitroreductase/CB1954, rabbit carboxylesterase/7-ethyl-10-[4-(1-piperidino)-1-piperidino] carbonyloxycampotothecin, mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin-glucoronide, thymidine phosphorylase/5'-deoxy-5-fluorouridine, deoxycytidine kinase/cytosine arabinoside, beta-lactamase and linamerase/linamarin. Additional exemplary prodrugs, for the use in combinations can also be found elsewhere herein (see e.g., Section I. THERAPEUTIC METHODS). Any of a variety of known combinations provided herein or otherwise known in the art can be included in the combinations provided herein.

In a further embodiment, combinations can include compounds that can kill or inhibit viral growth or toxicity. Combinations provided herein can contain antibiotic, antifungal, anti-parasitic or antiviral compounds for treatment of infections. Exemplary antibiotics which can be included in a combination with a virus provided herein include, but are not limited to, ceftazidime, cefepime, imipenem, aminoglycoside, vancomycin and antipseudomonal β-lactam. Exemplary antifungal agents which can be included in a combination with a virus provided herein include, but are not limited to, amphotericin B, dapsone, fluconazole, flucytosine, griseofluvin, intraconazole, ketoconazole, miconazole, clotrimazole, nystatin, and combinations thereof. Exemplary antiviral agents can be included in a combination with a virus provided herein include, but are not limited to, cidofovir, alkoxyalkyl esters of cidofovir (CDV), cyclic CDV, and (S)-9-(3-hydroxy-2phosphonylmethoxypropyl)adenine, 5-(Dimethoxymethyl)-2'-deoxyuridine, isatin-beta-thiosemicarbazone, N-methanocarbathymidine, brivudin, 7-deazaneplanocin A, ST-246, Gleevec, 2'-beta-fluoro-2',3'-dideoxyadenosine, indinavir, nelfinavir, ritonavir, nevirapine, AZT, ddI, ddC, and combinations thereof. Typically, combinations with an antiviral agent contain an antiviral agent known to be effective against the virus of the combination. For example, combinations can contain a vaccinia virus with an antiviral compound, such as cidofovir, alkoxyalkyl esters of cidofovir, gancyclovir, acyclovir, ST-246, and Gleevec.

In another embodiment, the combination can further include a detectable compound. A detectable compound can include a ligand or substrate or other compound that can interact with and/or bind specifically to a virally expressed protein or RNA molecule, and can provide a detectable signal, such as a signal detectable by tomographic, spectroscopic, magnetic resonance, or other known techniques. Exemplary detectable compounds can be, or can contain, an imaging agent such as a magnetic resonance, ultrasound or tomographic imaging agent, including a radionuclide. The detectable compound can include any of a variety of compounds as provided elsewhere herein or are otherwise known in the art. Typically, the detectable compound included with a virus in the combinations provided herein will be a compound that is a substrate, a ligand, or can otherwise specifically interact with, a protein or RNA encoded by the virus; in some examples, the protein or RNA is an exogenous protein or RNA. Exemplary viruses/detectable compounds include a virus encoding luciferase/luciferin, β-galactosidase/(4,7,10-tri(acetic acid)-1-(2-β-galactopyranosylethoxy)-1,4,7,10-tetraazacyclododecane) gadolinium (Egad), and other combinations known in the art.

In another embodiment, the combination can further include a virus gene expression modulating compound. Compounds that modulate gene expression are known in the art, and include, but are not limited to, transcriptional activators, inducers, transcriptional suppressors, RNA polymerase inhibitors and RNA binding compounds such as siRNA or ribozymes. Any of a variety of gene expression modulating compounds known in the art can be included in the combinations provided herein. Typically, the gene expression modulating compound included with a virus in the combinations provided herein will be a compound that can bind, inhibit or react with one or more compounds, active in gene expression such as a transcription factor or RNA of the virus of the combination. An exemplary virus/expression modulator can be a virus encoding a chimeric transcription factor complex having a mutant human progesterone receptor fused to a yeast GAL4 DNA-binding domain an activation domain of the herpes simplex virus protein VP16 and also containing a synthetic promoter containing a series of GAL4 recognition sequences upstream of the adenovirus major late E1B TATA box, where the compound can be RU486 (see, e.g., Yu et al., (2002) *Mol Genet Genomics* 268:169-178). A variety of other virus/expression modulator combinations known in the art also can be included in the combinations provided herein.

In a further embodiment, combination can further contain nanoparticles. Nanoparticles can be designed such that they carry one or more therapeutic agents provided herein. Additionally, nanoparticles can be designed to carry a molecule that targets the nanoparticle to the tumor cells. In one non-

4. Kits

The viruses, cells, pharmaceutical compositions or combinations provided herein can be packaged as kits. Kits can optionally include one or more components such as instructions for use, devices and additional reagents, and components, such as tubes, containers and syringes for practice of the methods. Exemplary kits can include the viruses provided herein, and can optionally include instructions for use, a device for detecting a virus in a subject, a device for administering the virus to a subject, and a device for administering a compound to a subject.

In one example, a kit can contain instructions. Instructions typically include a tangible expression describing the virus and, optionally, other components included in the kit, and methods for administration, including methods for determining the proper state of the subject, the proper dosage amount, and the proper administration method, for administering the virus. Instructions can also include guidance for monitoring the subject over the duration of the treatment time.

In another example, a kit can contain a device for detecting a virus in a subject. Devices for detecting a virus in a subject can include a low light imaging device for detecting light, for example, emitted from luciferase, or fluoresced from fluorescent protein, such as a green or red fluorescent protein, a magnetic resonance measuring device such as an MRI or NMR device, a tomographic scanner, such as a PET, CT, CAT, SPECT or other related scanner, an ultrasound device, or other device that can be used to detect a protein expressed by the virus within the subject. Typically, the device of the kit will be able to detect one or more proteins expressed by the virus of the kit. Any of a variety of kits containing viruses and detection devices can be included in the kits provided herein, for example, a virus expressing luciferase and a low light imager or a virus expressing fluorescent protein, such as a green or red fluorescent protein, and a low light imager.

Kits provided herein also can include a device for administering a virus to a subject. Any of a variety of devices known in the art for administering medications or vaccines can be included in the kits provided herein. Exemplary devices include, but are not limited to, a hypodermic needle, an intravenous needle, a catheter, a needle-less injection device, an inhaler and a liquid dispenser, such as an eyedropper. Typically, the device for administering a virus of the kit will be compatible with the virus of the kit; for example, a needle-less injection device such as a high pressure injection device can be included in kits with viruses not damaged by high pressure injection, but is typically not included in kits with viruses damaged by high pressure injection.

Kits provided herein also can include a device for administering a compound to a subject. Any of a variety of devices known in the art for administering medications to a subject can be included in the kits provided herein. Exemplary devices include a hypodermic needle, an intravenous needle, a catheter, a needle-less injection, but are not limited to, a hypodermic needle, an intravenous needle, a catheter, a needle-less injection device, an inhaler and a liquid dispenser such as an eyedropper. Typically the device for administering the compound of the kit will be compatible with the desired method of administration of the compound. For example, a compound to be delivered subcutaneously can be included in a kit with a hypodermic needle and syringe.

G. THERAPEUTIC METHODS

Provided herein are therapeutic methods, including methods of treating and/or preventing immunoprivileged cells or tissue, including cancerous cells, tumors and metastases. Such sites, diseases and disorders include sites of cell proliferation, proliferative conditions, neoplasms, tumors, neoplastic disease, wounds and inflammation. The therapeutic methods provided herein include, but are not limited to, administering a virus provided herein to a subject containing a tumor and/or metastases. Viruses provided herein include viruses that have been modified using the methods provided herein. The administered viruses can posses one or more characteristics including attenuated pathogenicity, low toxicity, preferential accumulation in tumor, ability to activate an immune response against tumor cells, immunogenicity, replication competence, ability to express exogenous genes, and ability to elicit antibody production against an expressed gene product. The viruses can be administered for diagnosis and/or therapy of subjects, such as, but not limited to humans and other mammals, including rodents, dogs, cats, primates, or livestock.

In some embodiments, the viruses can accumulate in tumors or metastases. In some embodiments, the administration of a virus provided herein results in a slowing of tumor growth. In other embodiments, the administration of a virus provided herein results in a decrease in tumor volume. The therapeutic methods provided herein, however, do not require the administered virus to kill tumor cells or decrease the tumor size. Instead, the methods provided herein include administering to a subject a virus provided herein that can cause or enhance an anti-tumor immune response in the subject. In some embodiments, the viruses provided herein can be administered to a subject without causing viral-induced disease in the subject. In some embodiments, the viruses can elicit an anti-tumor immune response in the subject, where typically the viral-mediated anti-tumor immune response can develop, for example, over several days, a week or more, 10 days or more, two weeks or more, or a month or more. In some exemplary methods, the virus can be present in the tumor, and can cause an anti-tumor immune response without the virus itself causing enough tumor cell death to prevent tumor growth. In some embodiments, the tumor is a monotherapeutic tumor or monotherapeutic cancer, where the tumor or cancer does not decrease in volume when treated with the virus or a therapeutic agent alone.

In some embodiments, provided herein are methods for eliciting or enhancing antibody production against a selected antigen or a selected antigen type in a subject, where the methods include administering to a subject a virus that can accumulate in a tumor and/or metastasis, and can cause release of a selected antigen or selected antigen type from the tumor, resulting in antibody production against the selected antigen or selected antigen type. Any of a variety of antigens can be targeted in the methods provided herein, including a selected antigen such as an exogenous gene product expressed by the virus, or a selected antigen type such as one or more tumor antigens released from the tumor as a result of viral infection of the tumor (e.g., by lysis, apoptosis, secretion or other mechanism of causing antigen release from the tumor).

In some embodiments, it can be desirable to maintain release of the selected antigen or selected antigen type over a series of days, for example, at least a week, at least ten days, at least two weeks or at least a month. Provided herein are methods for providing a sustained antigen release within a subject, where the methods include administering to a subject a virus that can accumulate in a tumor and/or metastasis, and can cause sustained release of an antigen, resulting in antibody production against the antigen. The sustained release of antigen can result in an immune response by the viral-infected host, in which the host can develop antibodies against the antigen, and/or the host can mount an immune response against cells expressing the antigen, including an immune response against tumor cells. Thus, the sustained release of antigen can result in immunization against tumor cells. In some embodiments, the viral-mediated sustained antigen release-induced immune response against tumor cells can result in complete removal or killing of all tumor cells.

In some embodiments, the therapeutic methods provided herein inhibit tumor growth in a subject, where the methods include administering to a subject a virus that can accumulate in a tumor and/or metastasis, and can cause or enhance an anti-tumor immune response. The anti-tumor immune response induced as a result of tumor or metastases-accumulated viruses can result in inhibition of tumor growth.

In some embodiments, the therapeutic methods provided herein inhibit growth or formation of a metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in inhibition of metastasis growth or formation.

In other embodiments, the therapeutic methods provided herein decrease the size of a tumor and/or metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in a decrease in the size of the tumor and/or metastasis.

In some embodiments, the therapeutic methods provided herein eliminate a tumor and/or metastasis from a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in elimination of the tumor and/or metastasis from the subject.

Methods of reducing or inhibiting tumor growth, inhibiting metastasis growth and/or formation, decreasing the size of a tumor or metastasis, eliminating a tumor or metastasis, or other tumor therapeutic methods provided herein include causing or enhancing an anti-tumor immune response in the host. The immune response of the host, being anti-tumor in nature, can be mounted against tumors and/or metastases in which viruses have accumulated, and can also be mounted against tumors and/or metastases in which viruses have not accumulated, including tumors and/or metastases that form after administration of the virus to the subject. Accordingly, a tumor and/or metastasis whose growth or formation is inhibited, or whose size is decreased, or that is eliminated, can be a tumor and/or metastasis in which the viruses have accumulated, or also can be a tumor and/or metastasis in which the viruses have not accumulated. Accordingly, provided herein are methods of reducing or inhibiting tumor growth, inhibiting metastasis growth and/or formation, decreasing the size of a tumor or metastasis, eliminating a tumor or metastasis, or other tumor therapeutic methods, where the method includes administering to a subject a virus provided herein, where the virus accumulates in at least one tumor or metastasis and causes or enhances an anti-tumor immune response in the subject, and the immune response also is mounted against a tumor and/or metastasis in which the virus cell did not accumulate. In another embodiment, methods are provided for inhibiting or preventing recurrence of a neoplastic disease or inhibiting or preventing new tumor growth, where the methods include administering to a subject a virus provided herein that can accumulate in a tumor and/or metastasis, and can cause or enhance an anti-tumor immune response, and the anti-tumor immune response can inhibit or prevent recurrence of a neoplastic disease or inhibit or prevent new tumor growth.

The tumor or neoplastic disease therapeutic methods provided herein, such as methods of reducing or inhibiting tumor growth, inhibiting metastasis growth and/or formation, decreasing the size of a tumor or metastasis, eliminating a tumor or metastasis, or other tumor therapeutic methods, also can include administering to a subject a virus provided herein that can cause tumor cell lysis or tumor cell death. Such a virus can be the same virus as the virus that can cause or enhance an anti-tumor immune response in the subject. Viruses, such as the viruses provided herein, can cause cell lysis or tumor cell death as a result of expression of an endogenous gene or as a result of an exogenous gene. Endogenous or exogenous genes can cause tumor cell lysis or inhibit cell growth as a result of direct or indirect actions, as is known in the art, including lytic channel formation or activation of an apoptotic pathway. Gene products, such as exogenous gene products can function to activate a prodrug to an active, cytotoxic form, resulting in cell death where such genes are expressed.

Such methods of antigen production or tumor and/or metastasis treatment can include administration of a virus provided herein for therapy, such as for gene therapy, for cancer gene therapy, or for vaccine therapy. Such a virus can be used to stimulate humoral and/or cellular immune response, induce strong cytotoxic T lymphocytes responses in subjects who can benefit from such responses. For example, the virus can provide prophylactic and therapeutic effects against a tumor infected by the virus or other infectious diseases, by rejection of cells from tumors or lesions using viruses that express immunoreactive antigens (Earl et al., *Science* 234: 728-831 (1986); Lathe et al., *Nature* (London) 32: 878-880 (1987)), cellular tumor-associated antigens (Bernards et al., *Proc. Natl. Acad. Sci. USA* 84: 6854-6858 (1987); Estin et al., *Proc. Natl. Acad. Sci. USA* 85: 1052-1056 (1988); Kantor et al., *J. Natl. Cancer Inst.* 84: 1084-1091 (1992); Roth et al., *Proc. Natl. Acad. Sci. USA* 93: 4781-4786 (1996)) and/or cytokines (e.g., IL-2, IL-12), costimulatory molecules (B7-1, B7-2) (Rao et al., *J. Immunol.* 156: 3357-3365 (1996); Chamberlain et al., *Cancer Res.* 56: 2832-2836 (1996); Oertli et al., *J. Gen. Virol.* 77: 3121-3125 (1996); Qin and Chatterjee, *Human Gene Ther.* 7: 1853-1860 (1996); McAneny et al., *Ann. Surg. Oncol.* 3: 495-500 (1996)), or other therapeutic proteins.

As shown previously, solid tumors can be treated with viruses, such as vaccinia viruses, resulting in an enormous tumor-specific virus replication, which can lead to tumor protein antigen and viral protein production in the tumors (U.S. Patent Publication No. 2005/0031643). Vaccinia virus administration to mice resulted in lysis of the infected tumor cells and a resultant release of tumor-cell-specific antigens. Continuous leakage of these antigens into the body led to a very high level of antibody titer (in approximately 7-14 days) against tumor proteins, viral proteins, and the virus encoded engineered proteins in the mice. The newly synthesized anti-tumor antibodies and the enhanced macrophage, neutrophils count were continuously delivered via the vasculature to the tumor and thereby provided for the recruitment of an activated immune system against the tumor. The activated immune system then eliminated the foreign compounds of the tumor including the viral particles. This interconnected release of foreign antigens boosted antibody production and continuous response of the antibodies against the tumor proteins to function like an autoimmunizing vaccination system initiated by vaccinia viral infection and replication, followed by cell lysis, protein leakage and enhanced antibody production. Thus, the viruses provided herein and the viruses generated using the methods provided herein can be administered in a complete process that can be applied to all tumor systems with immunoprivileged tumor sites as site of privileged viral growth, which can lead to tumor elimination by the host's own immune system.

In other embodiments, methods are provided for immunizing a subject, where the methods include administering to the subject a virus that expresses one or more antigens against which antigens the subject will develop an immune response. The immunizing antigens can be endogenous to the virus, such as vaccinia antigens on a vaccinia virus used to immunize against smallpox, measles, mumps, or the immunizing antigens can be exogenous antigens expressed by the virus, such as influenza or HIV antigens expressed on a viral capsid surface. In the case of smallpox, for example, a tumor specific protein antigen can be carried by an attenuated vaccinia virus (encoded by the viral genome) for a smallpox vaccine. Thus, the viruses provided herein, including the modified vaccinia viruses can be used as vaccines.

In one embodiment, the tumor treated is a cancer such as pancreatic cancer, non-small cell lung cancer, multiple myeloma or leukemia, although the cancer is not limited in this respect, and other metastatic diseases can be treated by the combinations provided herein. For example, the tumor treated can be a solid tumor, such as of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS. Exemplary tumors include, for example, pancreatic tumors, ovarian tumors, lung tumors, colon tumors, prostate tumors, cervical tumors and breast tumors. In one embodiment, the tumor is a carcinoma such as, for example, an ovarian tumor or a pancreatic tumor.

1. Administration

In performing the therapeutic methods provided herein, a virus can be administered to a subject, including a subject having a tumor or having neoplastic cells, or a subject to be immunized. An administered virus can be a virus provided herein or any other virus generated using the methods provided herein. In some embodiments, the virus administered is a virus containing a characteristic such as attenuated pathogenicity, low toxicity, preferential accumulation in tumor, ability to activate an immune response against tumor cells, high immunogenicity, replication competence and ability to express exogenous proteins, and combinations thereof.

a. Steps Prior to Administering the Virus

In some embodiments, one or more steps can be performed prior to administration of the virus to the subject. Any of a variety of preceding steps can be performed, including, but not limited to diagnosing the subject with a condition appropriate for virus administration, determining the immunocompetence of the subject, immunizing the subject, treating the subject with a chemotherapeutic agent, treating the subject with radiation, or surgically treating the subject.

For embodiments that include administering a virus to a tumor-bearing subject for therapeutic purposes, the subject has typically been previously diagnosed with a neoplastic condition. Diagnostic methods also can include determining the type of neoplastic condition, determining the stage of the neoplastic conditions, determining the size of one or more tumors in the subject, determining the presence or absence of metastatic or neoplastic cells in the lymph nodes of the subject, or determining the presence of metastases of the subject. Some embodiments of therapeutic methods for administering a virus to a subject can include a step of determination of the size of the primary tumor or the stage of the neoplastic disease, and if the size of the primary tumor is equal to or above a threshold volume, or if the stage of the neoplastic disease is at or above a threshold stage, a virus is administered to the subject. In a similar embodiment, if the size of the primary tumor is below a threshold volume, or if the stage of the neoplastic disease is at or below a threshold stage, the virus is not yet administered to the subject; such methods can include monitoring the subject until the tumor size or neoplastic disease stage reaches a threshold amount, and then administering the virus to the subject. Threshold sizes can vary according to several factors, including rate of growth of the tumor, ability of the virus to infect a tumor, and immunocompetence of the subject. Generally the threshold size will be a size sufficient for a virus to accumulate and replicate in or near the tumor without being completely removed by the host's immune system, and will typically also be a size sufficient to sustain a virus infection for a time long enough for the host to mount an immune response against the tumor cells, typically about one week or more, about ten days or more, or about two weeks or more. Exemplary threshold tumor sizes for viruses, such as vaccinia viruses, are at least about 100 mm$^3$, at least about 200 mm$^3$, at least about 300 mm$^3$, at least about 400 mm$^3$, at least about 500 mm$^3$, at least about 750 mm$^3$, at least about 1000 mm$^3$, or at least about 1500 mm$^3$. Threshold neoplastic disease stages also can vary according to several factors, including specific requirement for staging a particular neoplastic disease, aggressiveness of growth of the neoplastic disease, ability of the virus to infect a tumor or metastasis, and immunocompetence of the subject. Generally the threshold stage will be a stage sufficient for a virus to accumulate and replicate in a tumor or metastasis without being completely removed by the host's immune system, and will typically also be a size sufficient to sustain a virus infection for a time long enough for the host to mount an immune response against the neoplastic cells, typically about one week or more, about ten days or more, or about two weeks or more. Exemplary threshold stages are any stage beyond the lowest stage (e.g., Stage I or equivalent), or any stage where the primary tumor is larger than a threshold size, or any stage where metastatic cells are detected.

In other embodiments, prior to administering to the subject a virus, the immunocompetence of the subject can be determined. The methods of administering a virus to a subject provided herein can include causing or enhancing an immune response in a subject. Accordingly, prior to administering a virus to a subject, the ability of a subject to mount an immune response can be determined. Any of a variety of tests of immunocompetence known in the art can be performed in the methods provided herein. Exemplary immunocompetence tests can examine ABO hemagglutination titers (IgM), leukocyte adhesion deficiency (LAD), granulocyte function (NBT), T and B cell quantitation, tetanus antibody titers, salivary IgA, skin test, tonsil test, complement C3 levels, and factor B levels, and lymphocyte count. One skilled in the art can determine the desirability to administer a virus to a subject according to the level of immunocompetence of the subject, according to the immunogenicity of the virus, and, optionally, according to the immunogenicity of the neoplastic disease to be treated. Typically, a subject can be considered immunocompetent if the skilled artisan can determine that the subject is sufficiently competent to mount an immune response against the virus.

In some embodiments, the subject can be immunized prior to administering to the subject a virus according to the methods provided herein. Immunization can serve to increase the ability of a subject to mount an immune response against the virus, or increase the speed at which the subject can mount an immune response against a virus. Immunization also can serve to decrease the risk to the subject of pathogenicity of the virus. In some embodiments, the immunization can be performed with an immunization virus that is similar to the therapeutic virus to be administered. For example, the immunization virus can be a replication-incompetent variant of the therapeutic virus. In other embodiments, the immunization material can be digests of the therapeutic virus to be administered. Any of a variety of methods for immunizing a subject against a known virus are known in the art and can be used herein. In one example, vaccinia viruses treated with, for example, 1 microgram of psoralen and ultraviolet light at 365 nm for 4 minutes, can be rendered replication incompetent. In another embodiment, the virus can be selected as the same or similar to a virus against which the subject has been previously immunized, e.g., in a childhood vaccination.

In another embodiment, the subject can have administered thereto a virus without any previous steps of cancer treatment such as chemotherapy, radiation therapy or surgical removal of a tumor and/or metastases. The methods provided herein take advantage of the ability of the viruses to enter or localize near a tumor, where the tumor cells can be protected from the subject's immune system; the viruses can then proliferate in such an immunoprotected region and can also cause the release, typically a sustained release, of tumor antigens from the tumor to a location in which the subject's immune system can recognize the tumor antigens and mount an immune response. In such methods, existence of a tumor of sufficient size or sufficiently developed immunoprotected state can be advantageous for successful administration of the virus to the tumor, and for sufficient tumor antigen production. If a tumor is surgically removed, the viruses may not be able to localize to other neoplastic cells (e.g., small metastases) because such cells have not yet have matured sufficiently to create an immunoprotective environment in which the viruses can survive and proliferate, or even if the viruses can localize to neoplastic cells, the number of cells or size of the mass can be too small for the viruses to cause a sustained release of tumor antigens in order for the host to mount an anti-tumor immune response. Thus, for example, provided herein are methods of treating a tumor or neoplastic disease in which viruses are administered to a subject with a tumor or neoplastic disease without removing the primary tumor, or to a subject with a tumor or neoplastic disease in which at least some tumors or neoplastic cells are intentionally permitted to remain in the subject. In other typical cancer treatment methods such as chemotherapy or radiation therapy, such methods typically have a side effect of weakening the subject's immune system. This treatment of a subject by chemotherapy or radiation therapy can reduce the subject's ability to mount an anti-tumor immune response. Thus, for example, provided herein are methods of treating a tumor or neoplastic disease in which viruses are administered to a subject with a tumor or neoplastic disease without treating the subject with an immune system-weakening therapy, such as chemotherapy or radiation therapy.

In an alternative embodiment, prior to administration of a virus to the subject, the subject can be treated in one or more cancer treatment steps that do not remove the primary tumor or that do not weaken the immune system of the subject. A variety of more sophisticated cancer treatment methods are being developed in which the tumor can be treated without surgical removal or immune-system weakening therapy. Exemplary methods include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound. Thus, combined methods that include administering a virus to a subject can further improve cancer therapy. Thus, provided herein are methods of administering a virus to a subject, along with prior to or subsequent to, for example, administering a compound that slows tumor growth without weakening the subject's immune system or a compound that inhibits vascularization of the tumor.

b. Mode of Administration

Any mode of administration of a virus to a subject can be used, provided the mode of administration permits the virus to enter a tumor or metastasis. Modes of administration can include, but are not limited to, systemic, intravenous, intraperitoneal, subcutaneous, intramuscular, transdermal, intradermal, intra-arterial (e.g., hepatic artery infusion), intravesicular perfusion, intrapleural, intraarticular, topical, intratumoral, intralesional, multipuncture (e.g., as used with smallpox vaccines), inhalation, percutaneous, subcutaneous, intranasal, intratracheal, oral, intracavity (e.g., administering to the bladder via a catheter, administering to the gut by suppository or enema), vaginal, rectal, intracranial, intraprostatic, intravitreal, aural, or ocular administration.

One skilled in the art can select any mode of administration compatible with the subject and the virus, and that also is likely to result in the virus reaching tumors and/or metastases. The route of administration can be selected by one skilled in the art according to any of a variety of factors, including the nature of the disease, the kind of tumor, and the particular virus contained in the pharmaceutical composition. Administration to the target site can be performed, for example, by ballistic delivery, as a colloidal dispersion system, or systemic administration can be performed by injection into an artery.

c. Dosages

The dosage regimen can be any of a variety of methods and amounts, and can be determined by one skilled in the art according to known clinical factors. As is known in the medical arts, dosages for any one patient can depend on many factors, including the subject's species, size, body surface area, age, sex, immunocompetence, and general health, the particular virus to be administered, duration and route of administration, the kind and stage of the disease, for example, tumor size, and other treatments or compounds, such as chemotherapeutic drugs, being administered concurrently. In addition to the above factors, such levels can be affected by the infectivity of the virus, and the nature of the virus, as can be determined by one skilled in the art. In the present methods, appropriate minimum dosage levels of viruses can be levels sufficient for the virus to survive, grow and replicate in a tumor or metastasis. Exemplary minimum levels for administering a virus to a 65 kg human can include at least about $1 \times 10^5$ plaque forming units (PFU), at least about $5 \times 10^5$ PFU, at least about $1 \times 10^6$ PFU, at least about $5 \times 10^6$ PFU, at least about $1 \times 10^7$ PFU, at least about $1 \times 10^8$ PFU, at least about $1 \times 10^9$ PFU, or at least about $1 \times 10^{10}$ PFU. In the present methods, appropriate maximum dosage levels of viruses can be levels that are not toxic to the host, levels that do not cause splenomegaly of 3 times or more, levels that do not result in colonies or plaques in normal tissues or organs after about 1 day or after about 3 days or after about 7 days. Exemplary maximum levels for administering a virus to a 65 kg human can include no more than about $1 \times 10^{11}$ PFU, no more than about $5 \times 10^{10}$ PFU, no more than about $1 \times 10^{10}$ PFU, no more than about $5 \times 10^9$ PFU, no more than about $1 \times 10^9$ PFU, or no more than about $1 \times 10^8$ PFU.

For combination therapies with chemotherapeutic compounds, dosages for the administration of such compounds are known in the art or can be determined by one skilled in the art according to known clinical factors (e.g., subject's species, size, body surface area, age, sex, immunocompetence, and general health, duration and route of administration, the kind and stage of the disease, for example, tumor size, and other viruses, treatments, or compounds, such as other chemotherapeutic drugs, being administered concurrently). In addition to the above factors, such levels can be affected by the infectivity of the virus, and the nature of the virus, as can be determined by one skilled in the art. For example, Cisplatin (also called cis-platinum, platinol; cis-diamminedichloroplatinum; and cDDP) is representative of a broad class of water-soluble, platinum coordination compounds frequently employed in the therapy of testicular cancer, ovarian tumors and a variety of other cancers. (See, e.g., Blumenreich et al. *Cancer* 55(5): 1118-1122 (1985); Forastiere et al. *J. Clin. Oncol.* 19(4): 1088-1095 (2001)). Methods of employing cisplatin clinically are well known in the art. For example, cisplatin has been administered in a single day over a six hour period, once per month, by slow intravenous infusion. For localized lesions, cisplatin can be administered by local injection. Intraperitoneal infusion can also be employed. Cisplatin can be administered in doses as low as 10 mg/m$^2$ per treatment if part of a multi-drug regimen, or if the patient has an adverse reaction to higher dosing. In general, a clinical dose is from about 30 to about 120 or 150 mg/m$^2$ per treatment.

Typically, platinum-containing chemotherapeutic agents are administered parenterally, for example by slow intravenous infusion, or by local injection, as discussed above. The effects of intralesional (intra-tumoral) and IP administration of cisplatin is described in (Nagase et al. *Cancer Treat. Rep.* 71(9): 825-829 (1987); and Theon et al. *J. Am. Vet. Med. Assoc.* 202(2): 261-7. (1993)).

In one exemplary embodiment, the mutant vaccinia virus is administered once or 2-4 times with 0-60 days apart, followed by 1-30 days where no anti-cancer treatment is administered, then cisplatin is administered daily for 1-5 days, followed by 1-30 days where no anti-cancer treatment is administered. Each component of the therapy, virus or cisplatin treatment, or the virus and cisplatin combination therapy can be repeated. In another exemplary embodiment, cisplatin is administered daily for 1 to 5 days, followed by 1-10 days where no anti-cancer treatment is administered, then the mutant vaccinia virus is administered once or 2-4 times with 0-60 days apart. Such treatment scheme can be repeated. In another exemplary embodiment, cisplatin is administered daily for 1 to 5 days, followed by 1-10 days where no anti-cancer treatment is administered, then the mutant vaccinia virus is administered once or 2-4 times with 0-60 days apart. This is followed by 5-60 days where no anti-cancer treatment is administered, then cisplatin is administered again for 1-5 days. Such treatment scheme can be repeated.

Gemcitabine (GEMZAR®) is another compound employed in the therapy of breast cancer, non-small cell lung cancer, and pancreatic cancer. Gemcitabine is a nucleoside analogue that exhibits antitumor activity. Methods of employing gemcitabine clinically are well known in the art. For example, gemcitabine has been administered by intravenous infusion at a dose of 1000 mg/m$^2$ over 30 minutes once weekly for up to 7 weeks (or until toxicity necessitates reducing or holding a dose), followed by a week of rest from treatment of pancreatic cancer. Subsequent cycles can consist of infusions once weekly for 3 consecutive weeks out of every 4 weeks. Gemcitabine has also been employed in combination with cisplatin in cancer therapy.

In one exemplary embodiment, the mutant vaccinia virus is administered once or 2-4 times with 0-60 days apart, followed by 1-30 days where no anti-cancer treatment is administered, then gemcitabine is administered 1-7 times with 0-30 days apart, followed by 1-30 days where no anti-cancer treatment is administered. Such treatment scheme can be repeated. In another exemplary embodiment, gemcitabine is administered 1-7 times with 0-30 days apart, followed by 1-10 days where no anti-cancer treatment is administered, then the mutant vaccinia virus is administered once or 2-4 times with 0-60 days apart. This is followed by 5-60 days where no anti-cancer treatment is administered. Such treatment scheme can be repeated. In another exemplary embodiment, gemcitabine is administered 1-7 times with 0-30 days apart, followed by 1-10 days where no anti-cancer treatment is administered, then the mutant vaccinia virus is administered once or 2-4 times with 0-60 days apart. This is followed by 5-60 days where no anti-cancer treatment is administered, then gemcitabine is administered again for 1-7 times with 0-30 days apart. Such treatment scheme can be repeated.

As will be understood by one of skill in the art, the optimal treatment regimen will vary and it is within the scope of the treatment methods to evaluate the status of the disease under treatment and the general health of the patient prior to, and following one or more cycles of combination therapy in order to determine the optimal therapeutic combination.

d. Number of Administrations

The methods provided herein can include a single administration of a virus to a subject or multiple administrations of a virus to a subject. In some embodiments, a single administration is sufficient to establish a virus in a tumor, where the virus can proliferate and can cause or enhance an anti-tumor response in the subject; such methods do not require additional administrations of a virus in order to cause or enhance an anti-tumor response in a subject, which can result, for example in inhibition of tumor growth, inhibition of metastasis growth or formation, reduction in tumor or size, elimination of a tumor or metastasis, inhibition or prevention of recurrence of a neoplastic disease or new tumor formation, or other cancer therapeutic effects. In other embodiments, a virus can be administered on different occasions, separated in time typically by at least one day. Separate administrations can increase the likelihood of delivering a virus to a tumor or metastasis, where a previous administration has been ineffective in delivering a virus to a tumor or metastasis. Separate administrations can increase the locations on a tumor or metastasis where virus proliferation can occur or can otherwise increase the titer of virus accumulated in the tumor, which can increase the scale of release of antigens or other compounds from the tumor in eliciting or enhancing a host's anti-tumor immune response, and also can, optionally, increase the level of virus-based tumor lysis or tumor cell death. Separate administrations of a virus can further extend a subject's immune response against viral antigens, which can extend the host's immune response to tumors or metastases in which viruses have accumulated, and can increase the likelihood of a host mounting an anti-tumor immune response.

When separate administrations are performed, each administration can be a dosage amount that is the same or different relative to other administration dosage amounts. In one embodiment, all administration dosage amounts are the same. In other embodiments, a first dosage amount can be a larger dosage amount than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, smaller amount relative to the first administration.

Separate administrations can include any number of two or more administrations, including two, three, four, five or six administrations. One skilled in the art can readily determine the number of administrations to perform or the desirability of performing one or more additional administrations according to methods known in the art for monitoring therapeutic methods and other monitoring methods provided herein. Accordingly, the methods provided herein include methods of providing to the subject one or more administrations of a virus, where the number of administrations can be determined by monitoring the subject, and, based on the results of the monitoring, determining whether or not to provide one or more additional administrations. Deciding on whether or not to provide one or more additional administrations can be based on a variety of monitoring results, including, but not limited to, indication of tumor growth or inhibition of tumor growth, appearance of new metastases or inhibition of metastasis, the subject's anti-virus antibody titer, the subject's anti-tumor antibody titer, the overall health of the subject, the weight of the subject, the presence of virus solely in tumor and/or metastases, the presence of virus in normal tissues or organs.

The time period between administrations can be any of a variety of time periods. The time period between administrations can be a function of any of a variety of factors, including monitoring steps, as described in relation to the number of administrations, the time period for a subject to mount an immune response, the time period for a subject to clear the virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

e. Co-Administrations

Also provided are methods in which an additional therapeutic substance, such as a different therapeutic virus or a therapeutic compound is administered. These can be administered simultaneously, sequentially or intermittently with the first virus. The additional therapeutic substance can interact with the virus or a gene product thereof, or the additional therapeutic substance can act independently of the virus.

Combination therapy treatment has advantages in that: 1) it avoids single agent resistance; 2) in a heterogeneous tumor population, it can kill cells by different mechanisms; and 3) by selecting drugs with non-overlapping toxicities, each agent can be used at full dose to elicit maximal efficacy and synergistic effect. Combination therapy can be done by combining a diagnostic/therapeutic virus with one or more of the following anti-cancer agents: chemotherapeutic agents, therapeutic antibodies, siRNAs, toxins, enzyme-prodrug pairs or radiation.

i. Administering a Plurality of Viruses

Methods are provided for administering to a subject two or more viruses. Administration can be effected simultaneously, sequentially or intermittently. The plurality of viruses can be administered as a single composition or as two or more compositions. The two or more viruses can include at least two viruses. In a particular embodiment, where there are two viruses, both viruses are vaccinia viruses. In another embodiment, one virus is a vaccinia virus and the second virus is any one of an adenovirus, an adeno-associated virus, a retrovirus, a herpes simplex virus, a reovirus, a mumps virus, a foamy virus, an influenza virus, a myxoma virus, a vesicular stomatitis virus, or any other virus described herein or known in the art. Viruses can be chosen based on the pathway on which they act. For example, a virus that targets an activated Ras pathway can be combined with a virus that targets tumor cells defective in p53 expression.

The plurality of viruses can be provided as combinations of compositions and/or as kits that include the viruses packaged for administration and optionally including instructions therefore. The compositions can contain the viruses formulated for single dosage administration (i.e., for direct administration) and can require dilution or other additions.

In one embodiment, at least one of the viruses is a modified virus such as those provided herein, having a characteristic such as low pathogenicity, low toxicity, preferential accumulation in tumor, ability to activate an immune response against tumor cells, immunogenic, replication competent, ability to express exogenous proteins, and combinations thereof. The viruses can be administered at approximately the same time, or can be administered at different times. The viruses can be administered in the same composition or in the same administration method, or can be administered in separate composition or by different administration methods.

The time period between administrations can be any time period that achieves the desired effects, as can be determined by one skilled in the art. Selection of a time period between administrations of different viruses can be determined according to parameters similar to those for selecting the time period between administrations of the same virus, including results from monitoring steps, the time period for a subject to mount an immune response, the time period for a subject to clear virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

ii. Therapeutic Compounds

Any therapeutic or anti-cancer agent can be used as the second, therapeutic or anti-cancer agent in the combined cancer treatment methods provided herein. The methods can include administering one or more therapeutic compounds to the subject in addition to administering a virus or plurality thereof to a subject. Therapeutic compounds can act independently, or in conjunction with the virus, for tumor therapeutic effects.

Therapeutic compounds that can act independently include any of a variety of known chemotherapeutic compounds that can inhibit tumor growth, inhibit metastasis growth and/or formation, decrease the size of a tumor or metastasis, eliminate a tumor or metastasis, without reducing the ability of a virus to accumulate in a tumor, replicate in the tumor, and cause or enhance an anti-tumor immune response in the subject.

Therapeutic compounds that act in conjunction with the viruses include, for example, compounds that alter the expression of the viruses or compounds that can interact with a virally-expressed gene, or compounds that can inhibit virus proliferation, including compounds toxic to the virus. Therapeutic compounds that can act in conjunction with the virus include, for example, therapeutic compounds that increase the proliferation, toxicity, tumor cell killing or immune response eliciting properties of a virus, and also can include, for example, therapeutic compounds that decrease the proliferation, toxicity or cell killing properties of a virus. Optionally, the therapeutic agent can exhibit or manifest additional properties, such as, properties that permit its use as an imaging agent, as described elsewhere herein.

Therapeutic compounds also include, but are not limited to, chemotherapeutic agents, nanoparticles, radiation therapy, siRNA molecules, enzyme/pro-drug pairs, photosensitizing agents, toxins, microwaves, a radionuclide, an angiogenesis inhibitor, a mitosis inhibitor protein (e.g., cdc6), an antitumor oligopeptide (e.g., antimitotic oligopeptides, high affinity tumor-selective binding peptides), a signaling modulator, anti-cancer antibiotics, or a combination thereof.

Exemplary photosensitizing agents include, but are not limited to, for example, indocyanine green, toluidine blue, aminolevulinic acid, texaphyrins, benzoporphyrins, phenothiazines, phthalocyanines, porphyrins such as sodium porfimer, chlorins such as tetra(m-hydroxyphenyl)chlorin or tin(IV) chlorin e6, purpurins such as tin ethyl etiopurpurin, purpurinimides, bacteriochlorins, pheophorbides, pyropheophorbides or cationic dyes. In one embodiment, a vaccinia virus, such as a vaccinia virus provided herein, is administered to a subject having a tumor, cancer or metastasis in combination with a photosensitizing agent.

Radionuclides, which depending up the radionuclide, amount and application can be used for diagnosis and/or for treatment. They include, but are not limited to, for example, a compound or molecule containing $^{32}$Phosphate, $^{60}$Cobalt, $^{90}$Yttirum, $^{99}$Technicium, $^{103}$Palladium, $^{106}$Ruthenium, $^{111}$Indium, $^{117}$Lutetium, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth or $^{213}$Bismuth. In one embodiment, a vaccinia virus, such as a vaccinia virus provided herein, is administered to a subject having a tumor, cancer or metastasis in combination with a radionuclide.

Toxins include, but are not limited to, chemotherapeutic compounds such as, but not limited to, 5-fluorouridine, calicheamicin and maytansine. Signaling modulators include, but are not limited to, for example, inhibitors of macrophage inhibitory factor, toll-like receptor agonists and stat 3 inhibitors. In one embodiment, a vaccinia virus, such as a vaccinia virus provided herein, is administered to a subject having a tumor, cancer or metastasis in combination with a toxin or a signaling modulator.

Combination therapy between chemotherapeutic agents and therapeutic viruses can be effective/curative in situations when single agent treatment is not effective. Chemotherapeutic compounds include, but are not limited to, alkylating agents such as thiotepa and cyclosphosphamide; alkyl sulfonates such as busulfan, improsulfan and piposulfan; aziridines such as benzodopa, carboquone, meturedopa and uredopa; ethylenimines and methylamelamines including altretamine, triethylenemelamine, triethylenephosphoramide, triethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenishers such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; polysaccharide-K; razoxane; sizofuran; spirogermanium; tenuazonic acid; triaziquone; 2,2',2''-trichlorotriethylamine; urethan; vindesine; dacarbazine; mannomustine; mitobronitol; mitolactol; pipobroman; gacytosine; cytosine arabinoside; cyclophosphamide; thiotepa; taxoids, e.g., paclitaxel and doxetaxel; chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT11; topoisomerase inhibitor RFS 2000; difluoromethylornithine (DMFO); retinoic acid; esperamicins; capecitabine; sunitinib malate (SUTENT) and pharmaceutically acceptable salts, acids or derivatives of any of the above. Also included are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (Fareston); and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods. Chemotherapeutic agents also include new classes of targeted chemotherapeutic agents such as, for example, imatinib (sold by Novartis under the trade name Gleevec in the United States), gefitinib (developed by Astra Zeneca under the trade name Iressa) and erlotinib (TARCEVA). Particular chemotherapeutic agents include, but are not limited to, cisplatin, carboplatin, oxaliplatin, DWA2114R, NK121, IS 3 295, and 254-S vincristine, prednisone, doxorubicin and L-asparaginase; mechloroethamine, vincristine, procarbazine and prednisone (MOPP); cyclophosphamide, vincristine, procarbazine and prednisone (C-MOPP); bleomycin, vinblastine, gemcitabine and 5-fluorouracil. Exemplary chemotherapeutic agents are, for example, cisplatin, carboplatin, oxaliplatin, DWA2114R, NK121, IS 3 295, and 254-S. In a non-limiting embodiment, a vaccinia virus, such as a vaccinia virus provided herein, is administered to a subject having a tumor, cancer or metastasis in combination with a platinum coordination complex, such as cisplatin, carboplatin, oxaliplatin, DWA2114R, NK121, IS 3 295, and 254-S. Tumors, cancers and metastasis can be any of those provided herein, and in particular, can be a pancreatic tumor, an ovarian tumor, a lung tumor, a colon tumor, a prostate tumor, a cervical tumor or a breast tumor; exemplary tumors are pancreatic and ovarian tumors. Tumors, cancers and metastasis can be a monotherapy-resistant tumor such as, for example, one that does not respond to therapy with virus alone or anti-cancer agent alone, but that does respond to therapy with a combination of virus and anti-cancer agent. Typically, a therapeutically effective amount of virus is systemically administered to the subject and the virus localizes and accumulates in the tumor. Subsequent to administering the virus, the subject is administered a therapeutically effective amount of an anti-cancer agent, such as cisplatin. In one example, cisplatin is administered once-daily for five consecutive days. One of skill in the art could determine when to administer the anti-cancer agent subsequent to the virus using, for example, in vivo animal models. Using the methods provided herein, administration of a virus and anti-cancer agent, such as cisplatin can cause a reduction in tumor volume, can cause tumor growth to stop or be delayed or can cause the tumor to be eliminated from the subject. The status of tumors, cancers and metastasis following treatment can be monitored using any of the methods provided herein and known in the art.

Exemplary anti-cancer antibiotics include, but are not limited to, anthracyclines such as doxorubicin hydrochloride (adriamycin), idarubicin hydrochloride, daunorubicin hydrochloride, aclarubicin hydrochloride, epirubicin hydrochloride and purarubicin hydrochloride, pleomycins such as pleomycin and peplomycin sulfate, mitomycins such as mitomycin C, actinomycins such as actinomycin D, zinostatinstimalamer and polypeptides such as neocarzinostatin. In one embodiment, a vaccinia virus, such as a vaccinia virus provided herein, is administered to a subject having a tumor, cancer or metastasis in combination with an anti-cancer antibiotic.

In one embodiment, nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen. In one embodiment, a vaccinia virus, such as a vaccinia virus provided herein, is administered to a subject having a tumor, cancer or metastasis in combination with a nanoparticle carrying any of the therapeutic agents provided herein.

Radiation therapy has become a foremost choice of treatment for a majority of cancer patients. The wide use of radiation treatment stems from the ability of gamma-irradiation to induce irreversible damage in targeted cells with the preservation of normal tissue function. Ionizing radiation triggers apoptosis, the intrinsic cellular death machinery in cancer cells, and the activation of apoptosis seems to be the principal mode by which cancer cells die following exposure to ionizing radiation. In one embodiment, a vaccinia virus, such as a vaccinia virus provided herein, is administered to a subject having a tumor, cancer or metastasis in combination with radiation therapy.

Thus, provided herein are methods of administering to a subject one or more therapeutic compounds that can act in conjunction with the virus to increase the proliferation, toxicity, tumor cell killing, or immune response eliciting properties of a virus. Also provided herein are methods of administering to a subject one or more therapeutic compounds that can act in conjunction with the virus to decrease the proliferation, toxicity, or cell killing properties of a virus. Therapeutic compounds to be administered can be any of those provided herein or in the art.

Therapeutic compounds that can act in conjunction with the virus to increase the proliferation, toxicity, tumor cell killing or immune response eliciting properties of a virus are compounds that can alter gene expression, where the altered gene expression can result in an increased killing of tumor cells or an increased anti-tumor immune response in the subject. A gene expression-altering compound can, for example, cause an increase or decrease in expression of one or more viral genes, including endogenous viral genes and/or exogenous viral genes. For example, a gene expression-altering compound can induce or increase transcription of a gene in a virus such as an exogenous gene that can cause cell lysis or cell death, that can provoke an immune response, that can catalyze conversion of a prodrug-like compound, or that can inhibit expression of a tumor cell gene. Any of a wide variety of compounds that can alter gene expression are known in the art, including IPTG and RU486. Exemplary genes whose expression can be up-regulated include proteins and RNA molecules, including toxins, enzymes that can convert a prodrug to an anti-tumor drug, cytokines, transcription regulating proteins, siRNA and ribozymes. In another example, a gene expression-altering compound can inhibit or decrease transcription of a gene in a virus such as a heterologous gene that can reduce viral toxicity or reduces viral proliferation.

Any of a variety of compounds that can reduce or inhibit gene expression can be used in the methods provided herein, including siRNA compounds, transcriptional inhibitors or inhibitors of transcriptional activators. Exemplary genes whose expression can be down-regulated include proteins and RNA molecules, including viral proteins or RNA that suppress lysis, nucleotide synthesis or proliferation, and cellular proteins or RNA molecules that suppress cell death, immunoreactivity, lysis, or viral replication.

In another embodiment, therapeutic compounds that can act in conjunction with the virus to increase the proliferation, toxicity, tumor cell killing, or immune response eliciting properties of a virus are compounds that can interact with a virally expressed gene product, and such interaction can result in an increased killing of tumor cells or an increased anti-tumor immune response in the subject. A therapeutic compound that can interact with a virally-expressed gene product can include, for example a prodrug or other compound that has little or no toxicity or other biological activity in its subject-administered form, but after interaction with a virally expressed gene product, the compound can develop a property that results in tumor cell death, including but not limited to, cytotoxicity, ability to induce apoptosis, or ability to trigger an immune response. In one non-limiting example, the virus carries an enzyme into the cancer cells. Once the enzyme is introduced into the cancer cells, an inactive form of a chemotherapy drug (i.e., a prodrug) is administered. When the inactive prodrug reaches the cancer cells, the enzyme converts the prodrug into the active chemotherapy drug, so that it can kill the cancer cell. Thus, the treatment is targeted only to cancer cells and does not affect normal cells. The prodrug can be administered concurrently with, or sequentially to, the virus. A variety of prodrug-like substances are known in the art and an exemplary set of such compounds are disclosed elsewhere herein, where such compounds can include gancyclovir, 5-fluorouracil, 6-methylpurine deoxyriboside, cephalosporin-doxorubicin, 4-[(2-chloroethyl)(2-mesyloxyethyl)amino]benzoyl-L-glutamic acid, acetaminophen, indole-3-acetic acid, CB1954, 7-ethyl-10-[4-(1-piperidino)-1-piperidino]carbonyloxycamptothecin, bis-(2-chloroethyl)amino-4-hydroxyphenylaminomethanone 28, 1-chloromethyl-5-hydroxy-1,2-dihydro-3H-benz[e]indole, epirubicin-glucuronide, 5'-deoxy-5-fluorouridine, cytosine arabinoside, linamarin, and a nucleoside analogue (e.g., fluorouridine, fluorodeoxyuridine, fluorouridine arabinoside, cytosine arabinoside, adenine arabinoside, guanine arabinoside, hypoxanthine arabinoside, 6-mercaptopurineriboside, theoguanosine riboside, nebularine, 5-iodouridine, 5-iododeoxyuridine, 5-bromodeoxyuridine, 5-vinyldeoxyuridine, 9-[(2-hydroxy)ethoxy]methylguanine (acyclovir), 9-[(2-hydroxy-1-hydroxymethyl)-ethoxy]methylguanine (DHPG), azauridine, azacytidine, azidothymidine, dideoxyadenosine, dideoxycytidine, dideoxyinosine, dideoxyguanosine, dideoxythymidine, 3'-deoxyadenosine, 3'-deoxycytidine, 3'-deoxyinosine, 3'-deoxyguanosine, 3'-deoxythymidine).

In another embodiment, therapeutic compounds that can act in conjunction with the virus to decrease the proliferation, toxicity or cell killing properties of a virus are compounds that can inhibit viral replication, inhibit viral toxins or cause viral death. A therapeutic compound that can inhibit viral replication, inhibit viral toxins, or cause viral death can generally include a compound that can block one or more steps in the viral life cycle, including, but not limited to, compounds that can inhibit viral DNA replication, viral RNA transcription, viral coat protein assembly, outer membrane or polysaccharide assembly. Any of a variety of compounds that can block one or more steps in a viral life cycle are known in the art, including any known antiviral compound (e.g., cidofovir), viral DNA polymerase inhibitors, viral RNA polymerase inhibitors, inhibitors of proteins that regulate viral DNA replication or RNA transcription. In another example, a virus can contain a gene encoding a viral life cycle protein, such as DNA polymerase or RNA polymerase that can be inhibited by a compound that is, optionally, non-toxic to the host organism.

In addition to combination therapy between chemotherapeutic agents and a virus provided herein, other more complex combination therapy strategies could be applied as well. For example, a combination therapy can include chemotherapeutic agents, therapeutic antibodies, and a virus provided herein. Alternatively, another combination therapy can be the combination of radiation, therapeutic antibodies, and a virus provided herein. Therefore, the concept of combination therapy also can be based on the application of a virus provided herein virus along with one or more of the following therapeutic modalities, namely, chemotherapeutic agents, radiation therapy, therapeutic antibodies, hyper- or hypothermia therapy, siRNA, diagnostic/therapeutic bacteria, diagnostic/therapeutic mammalian cells, immunotherapy, and/or targeted toxins (delivered by antibodies, liposomes and nanoparticles).

Effective delivery of each components of the combination therapy is an important aspect of the methods provided herein. In accordance with one aspect, the modes of administration discussed below exploit one of more of the key features: (i) delivery of a virus provided herein to the tumors by a mode of administration effective to achieve highest titer of virus and highest therapeutic effect; (ii) delivery of any other mentioned therapeutic modalities to the tumor by a mode of administration to achieve the optimal therapeutic effect. The dose scheme of the combination therapy administered is such that the combination of the two or more therapeutic modalities is therapeutically effective. Dosages will vary in accordance with such factors as the age, health, sex, size and weight of the patient, the route of administration, the toxicity of the drugs, frequency of treatment, and the relative susceptibilities of the cancer to each of the therapeutic modalities.

iii. Immunotherapies and Biological Therapies

Therapeutic compounds also include, but are not limited to, compounds that exert an immunotherapeutic effect, stimulate the immune system, carry a therapeutic compound, or a combination thereof. Optionally, the therapeutic agent can exhibit or manifest additional properties, such as, properties that permit its use as an imaging agent, as described elsewhere herein. Such therapeutic compounds include, but are not limited to, anti-cancer antibodies, radiation therapy, siRNA molecules and compounds that suppress the immune system. Immunotherapy includes for example, immune-stimulating molecules (protein-based or non-protein-based), cells and antibodies. Immunotherapy treatments can include stimulating immune cells to act more effectively or to make the tumor cells or tumor associated antigens recognizable to the immune system (i.e., break tolerance).

Cytokines and growth factors include, but are not limited to, interleukins, such as, for example, interleukin-1, interleukin-2, interleukin-6 and interleukin-12, tumor necrosis factors, such as tumor necrosis factor alpha (TNF-$\alpha$), interferons such as interferon gamma (IFN-$\gamma$), granulocyte macrophage colony stimulating factors (GM-CSF), angiogenins, and tissue factors.

Anti-cancer antibodies include, but are not limited to, Rituximab, ADEPT, Trastuzumab (Herceptin), Tositumomab (Bexxar), Cetuximab (Erbitux), Ibritumomab (Zevalin), Alemtuzumab (Campath-1H), Epratuzumab (Lymphocide), Gemtuzumab ozogamicin (Mylotarg), Bevacizumab (Avastin), Tarceva (Erlotinib), SUTENT (sunitinib malate), Panorex (Edrecolomab), RITUXAN (Rituximab), Zevalin (90Y-ibritumomab tiuexetan), Mylotarg (Gemtuzumab Ozogamicin) and Campath (Alemtuzumab).

Thus, provided herein are methods of administering to a subject one or more therapeutic compounds that can act in conjunction with the virus to stimulate or enhance the immune system, thereby enhancing the effect of the virus. Such immunotherapy can be either delivered as a separate therapeutic modality or could be encoded (if the immunotherapy is protein-based) by the administered virus.

Biological therapies are treatments that use natural body substances or drugs made from natural body substances. They can help to treat a cancer and control side effects caused by other cancer treatments such as chemotherapy. Biological therapies are also sometimes called Biological Response Modifiers (BRM's), biologic agents or simply "biologics" because they stimulate the body to respond biologically (or naturally) to cancer. Immunotherapy is treatment using natural substances that the body uses to fight infection and disease. Because it uses natural substances, immunotherapy is also a biological therapy. There are several types of drugs that come under the term biological therapy: these include, for example, monoclonal antibodies (mAbs), cancer vaccines, growth factors for blood cells, cancer growth inhibitors, anti-angiogenic factors, interferon alpha, interleukin-2 (IL-2), gene therapy and BCG vaccine for bladder cancer.

Monoclonal antibodies (mAbs) are of particular interest for treating cancer because of the specificity of binding to a unique antigen and the ability to produce large quantities in the laboratory for mass distribution. Monoclonal antibodies can be engineered to act in the same way as immune system proteins: that is, to seek out and kill foreign matter in your body, such as viruses. Monoclonal antibodies can be designed to recognize epitopes on the surface of cancer cells. The antibodies specifically bind to the epitopes and either kill the cancer cells or deliver a therapeutic agent to the cancer cell. Methods of conjugating therapeutic agents to antibodies is well-known in the art. Different antibodies have to be made for different types of cancer; for example, Rituximab recognizes CD20 protein on the outside of non Hodgkin's lymphoma cells; ADEPT is a treatment using antibodies that recognize bowel (colon) cancer; and Trastuzumab (Herceptin) recognizes breast cancer cells that produce too much of the protein HER 2 ("HER 2 positive"). Other antibodies include, for example, Tositumomab (Bexxar), Cetuximab (Erbitux), Ibritumomab (Zevalin), Alemtuzumab (Campath-1H), Epratuzumab (Lymphocide), Gemtuzumab ozogamicin (Mylotarg) and Bevacizumab (Avastin). Thus, the viruses provided herein can be administered concurrently with, or sequentially to, one or more monoclonal antibodies in the treatment of cancer. In one embodiment, additional therapy is administered in the form of one or more of any of the other treatment modalities provided herein.

Rather than attempting to prevent infection, such as is the case with the influenza virus, cancer vaccines help treat the cancer once it has developed. The aim of cancer vaccines is to stimulate the immune response. Cancer vaccines include, for example, antigen vaccines, whole cell vaccines, dendritic cell vaccines, DNA vaccines and anti-idiotype vaccines. Antigen vaccines are vaccines made from tumor-associated antigens in, or produced by, cancer cells. Antigen vaccines stimulate a subject's immune system to attack the cancer. Whole cell vaccines are vaccines that use the whole cancer cell, not just a specific antigen from it, to make the vaccine. The vaccine is made from a subject's own cancer cells, another subject's cancer cells or cancer cells grown in a laboratory. The cells are treated in the laboratory, usually with radiation, so that they can't grow, and are administered to the subject via injection or through an intravenous drip into the bloodstream so they can stimulate the immune system to attack the cancer. One type of whole cell vaccine is a dendritic cell vaccine, which help the immune system to recognize and attack abnormal cells, such as cancer cells. Dendritic cell vaccines are made by growing dendritic cells alongside the cancer cells in the lab. The vaccine is administered to stimulate the immune system to attack the cancer. Anti-idiotype vaccines are vaccines that stimulate the body to make antibodies against cancer cells. Cancer cells make some tumor-associated antigens that the immune system recognizes as foreign. But because cancer cells are similar to non-cancer cells, the immune system can respond weakly. DNA vaccines boost the immune response. DNA vaccines are made from DNA from cancer cells that carry the genes for the tumor-associated antigens. When a DNA vaccine is injected, it enables the cells of the immune system to recognize the tumor-associated antigens, and activates the cells in the immune system (i.e., breaking tolerance). The most promising results from using DNA vaccines are in treating melanoma. Thus, the viruses provided herein can be administered concurrently with, or sequentially to, a whole cell vaccine in the treatment of cancer. In one embodiment, additional therapy is administered in the form of one or more of any of the other treatment modalities provided herein.

Growth factors are natural substances that stimulate the bone marrow to make blood cells. Recombinant technology can be used to generate growth factors which can be administered to a subject to increase the number of white blood cells, red blood cells and stem cells in the blood. Growth factors used in cancer treatment to boost white blood cells include Granulocyte Colony Stimulating Factor (G-CSF) also called filgrastim (Neupogen) or lenograstim (Granocyte) and Granulocyte and Macrophage Colony Stimulating Factor (GM-CSF), also called molgramostim. A growth factor to help treat anemia is erythropoietin (EPO). EPO encourages the body to make more red blood cells, which in turn, increases hemoglobin levels and the levels of oxygen in body tissues. Other growth factors are being developed which can boost platelets. Thus, the viruses provided herein can be administered concurrently with, or sequentially to, a growth factor such as GM-CSF, in the treatment of cancer. In one embodiment, additional therapy is administered in the form of one or more of any of the other treatment modalities provided herein.

Cancer growth inhibitors use cell-signaling molecules which control the growth and multiplication of cells, such as cancer cells. Drugs that block these signaling molecules can stop cancers from growing and dividing. Cancer growth factors include, but are not limited to, tyrosine kinases. Thus, drugs that block tyrosine kinases are tyrosine kinase inhibitors (TKIs). Examples of TKIs include, but are not limited to, Erlotinib (Tarceva, OSI-774), Iressa (Gefitinib, ZD 1839) and Imatinib (Glivec, STI 571). Another type of growth inhibitor is Bortezomib (Velcade) for multiple myeloma and for some other cancers. Velcade is a proteasome inhibitor. Proteasomes are found in all cells and help break down proteins in cells. Interfering with the action of proteosomes causes a build up of proteins in the cell to toxic levels; thereby killing the cancer cells. Cancer cells are more sensitive to Velcade than normal cells. Thus, the viruses provided herein can be administered concurrently with, or sequentially to, a cancer growth inhibitor, such as Velcade, in the treatment of cancer. In one embodiment, additional therapy is administered in the form of one or more of any of the other treatment modalities provided herein.

Cancers need a blood supply to expand and grow their own blood vessels as they get bigger. Without its own blood supply, a cancer cannot grow due to lack of nutrients and oxygen. Anti-angiogenic drugs stop tumors from developing their own blood vessels. Examples of these types of drugs include, but are not limited to, Thalidomide, mainly for treating myeloma but also in trials for other types of cancer, and Bevacizumab (Avastin), a type of monoclonal antibody that has been investigated for bowel cancer. Thus, the viruses provided herein can be administered concurrently with, or sequentially to, an anti-angiogenic drug in the treatment of cancer. In one embodiment, additional therapy is administered in the form of one or more of any of the other treatment modalities provided herein.

Interferon-alpha (IFN-α) is a natural substance produced in the body, in very small amounts, as part of the immune response. IFN-α is administered as a treatment to boost the immune system and help fight cancers such as renal cell (kidney) cancer, malignant melanoma, multiple myeloma and some types of leukemias. IFN-α works in several ways: it can help to stop cancer cells growing, it can also boost the immune system to help it attack the cancer, and it can affect the blood supply to the cancer cells. Thus, the viruses provided herein can be administered concurrently with, or sequentially to, IFN-α in the treatment of cancer. In one embodiment, additional therapy is administered in the form of one or more of any of the other treatment modalities provided herein.

Administration of IL-2 is a biological therapy drug because it is naturally produced by the immune system. Thus, it is also an immunotherapy. Interleukin 2 is used in treating renal cell (kidney) cancer, and is being tested in clinical trials for several other types of cancers. IL-2 works directly on cancer cells by interfering with cell grow and proliferation; it stimulates the immune system by promoting the growth of killer T cells and other cells that attack cancer cells; and it also stimulates cancer cells to secrete chemoattractants that attract immune system cells. IL-2 is generally administered as a subcutaneous injection just under the skin once daily for 5 days, followed by 2 days rest. The cycle of injections is repeated for 4 weeks followed by a week without treatment. The treatment regiment and the number of cycles administered depends on the type of cancer and how it responds to the treatment. IL-2 can be self-administered or administered by a health professional. Alternatively, IL-2 can be administered intravenously via injection or drip. Thus, the viruses provided herein can be administered concurrently with, or sequentially to, IL-2 in the treatment of cancer. In one embodiment, additional therapy is administered in the form of one or more of any of the other treatment modalities provided herein.

Gene therapy involves treating cancer by blocking abnormal genes in cancer cells, repairing or replacing abnormal genes in cancer cells, encouraging even more genes to become abnormal in cancer cells so that they die or become sensitive to treatment, using viruses to carry treatment-activating enzymes into the cancer cells, or a combination thereof. As a result, cancer cells die due to damage in the cell. Cancer cells develop as a result of several types of mutations in several of their genes. Targeted genes include, but are not limited to, those that encourage the cell to multiply (i.e., oncogenes), genes that stop the cell multiplying (i.e., tumor suppressor genes) and genes that repair other damaged genes. Gene therapy can involve repair of damaged oncogenes or blocking the proteins that the oncogenes produce. The tumor suppressor gene, p53, is damaged in many human cancers. Viruses have been used in to deliver an undamaged p53 gene into cancer cells, and early clinical trials are now in progress looking at treating cancers with modified p53-producing viruses. Gene therapy could be used to replace the damaged DNA repairing genes. In an alternative embodiment, methods of increasing DNA damage within a tumor cell can promote death of the tumor cell or cause increased susceptibility of the tumor cell to other cancer treatments, such as radiotherapy or chemotherapy. Thus, the viruses provided herein can be administered concurrently with, or sequentially to, any of the gene therapy methods provided herein or known in the art in the treatment of cancer. In one embodiment, additional therapy is administered in the form of one or more of any of the other treatment modalities provided herein.

Treatment of early stage bladder cancer is called intravesical treatment, which is mainly used to treat stage T1 bladder cancers that are high grade (grade 3 or G3) or carcinoma in situ of the bladder (also known as T is or CIS). BCG is a vaccine for tuberculosis (TB), which also has been found to be effective in treating CIS and preventing bladder cancers from recurring. In some cases, BCG vaccines have been used for treating grade 2 early bladder cancer. Because bladder cancer can occur anywhere in the bladder lining, it cannot be removed in the same way as the papillary early bladder cancers. Rather a BCG vaccine is administered using intravesical therapy; that is, first, a catheter (tube) put is inserted into the bladder, followed by intra-catheter administration of a BCG vaccine and/or a chemotherapy. BCG treatment occurs weekly for 6 weeks or more depending on the effect on the bladder cancer. BCG treatment of bladder cancer can be combined with other types of treatments, such as administration of chemotherapy (intravesical), IL-2, treatment with drugs that make cells sensitive to light, vitamins, and photodynamic therapy. Thus, the viruses provided herein can be administered concurrently with, or sequentially to, BCG vaccines in the treatment of cancer. In one embodiment, additional therapy is administered in the form of one or more of any of the other treatment modalities provided herein.

f. State of Subject

In another embodiment, the methods provided herein for administering a virus to a subject can be performed on a subject in any of a variety of states, including an anesthetized subject, an alert subject, a subject with elevated body temperature, a subject with reduced body temperature, or other state of the subject that is known to affect the accumulation of a virus in the tumor. As provided herein, it has been determined that a subject that is anesthetized can have a decreased rate of accumulation of a virus in a tumor relative to a subject that is not anesthetized. Further provided herein, it has been determined that a subject with decreased body temperature can have a decreased rate of accumulation of a virus in a tumor relative to a subject with a normal body temperature. Accordingly, provided herein are methods of administering a virus to a subject, where the methods can include administering a virus to a subject where the subject is not under anesthesia, such as general anesthesia; for example, the subject can be under local anesthesia, or can be unanesthetized. Also provided herein are methods of administering a virus to a subject, where the methods can include administering a virus to a subject with altered body temperature, where the alteration of the body temperature can influence the ability of the virus to accumulate in a tumor; typically, a decrease in body temperature can decrease the ability of a virus to accumulate in a tumor. Thus, in one exemplary embodiment, a method is provided for administering a virus to a subject, where the method includes elevating the body temperature of the subject to a temperature above normal, and administering a virus to the subject, where the virus can accumulate in the tumor more readily in the subject with higher body temperature relative to the ability of the virus to accumulate in a tumor of a subject with a normal body temperature. In another embodiment, localized elevations in temperature in the area surrounding the tumor can be used to increase the accumulation of the virus in the tumor.

2. Monitoring

The methods provided herein can further include one or more steps of monitoring the subject, monitoring the tumor, and/or monitoring the virus administered to the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, monitoring the subject's weight or other health indicators including blood or urine markers, monitoring anti-(viral antigen) antibody titer, monitoring viral expression of a detectable gene product, and directly monitoring viral titer in a tumor, tissue or organ of a subject.

The purpose of the monitoring can be simply for assessing the health state of the subject or the progress of therapeutic treatment of the subject, or can be for determining whether or not further administration of the same or a different virus is warranted, or for determining when or whether or not to administer a compound to the subject where the compound can act to increase the efficacy of the therapeutic method, or the compound can act to decrease the pathogenicity of the virus administered to the subject.

a. Monitoring Viral Gene Expression

In some embodiments, the methods provided herein can include monitoring one or more virally expressed genes. Viruses, such as those provided herein or otherwise known in the art, can express one or more detectable gene products, including but not limited to, detectable proteins.

As provided herein, measurement of a detectable gene product expressed by a virus can provide an accurate determination of the level of virus present in the subject. As further provided herein, measurement of the location of the detectable gene product, for example, by imaging methods including, but not limited to, magnetic resonance, fluorescence, and tomographic methods, can determine the localization of the virus in the subject. Accordingly, the methods provided herein that include monitoring a detectable viral gene product can be used to determine the presence or absence of the virus in one or more organs or tissues of a subject, and/or the presence or absence of the virus in a tumor or metastases of a subject. Further, the methods provided herein that include monitoring a detectable viral gene product can be used to determine the titer of virus present in one or more organs, tissues, tumors or metastases. Methods that include monitoring the localization and/or titer of viruses in a subject can be used for determining the pathogenicity of a virus; since viral infection, and particularly the level of infection, of normal tissues and organs can indicate the pathogenicity of the probe, methods of monitoring the localization and/or amount of viruses in a subject can be used to determine the pathogenicity of a virus. Since methods provided herein can be used to monitor the amount of viruses at any particular location in a subject, the methods that include monitoring the localization and/or titer of viruses in a subject can be performed at multiple time points, and, accordingly can determine the rate of viral replication in a subject, including the rate of viral replication in one or more organs or tissues of a subject; accordingly, the methods of monitoring a viral gene product can be used for determining the replication competence of a virus. The methods provided herein also can be used to quantitate the amount of virus present in a variety of organs or tissues, and tumors or metastases, and can thereby indicate the degree of preferential accumulation of the virus in a subject; accordingly, the viral gene product monitoring methods provided herein can be used in methods of determining the ability of a virus to accumulate in tumor or metastases in preference to normal tissues or organs. Since the viruses used in the methods provided herein can accumulate in an entire tumor or can accumulate at multiple sites in a tumor, and can also accumulate in metastases, the methods provided herein for monitoring a viral gene product can be used to determine the size of a tumor or the number of metastases that are present in a subject. Monitoring such presence of viral gene product in tumor or metastasis over a range of time can be used to assess changes in the tumor or metastasis, including growth or shrinking of a tumor, or development of new metastases or disappearance of metastases, and also can be used to determine the rate of growth or shrinking of a tumor, or development of new metastases or disappearance of metastases, or the change in the rate of growth or shrinking of a tumor, or development of new metastases or disappearance of metastases. Accordingly, the methods of monitoring a viral gene product can be used for monitoring a neoplastic disease in a subject, or for determining the efficacy of treatment of a neoplastic disease, by determining rate of growth or shrinking of a tumor, or development of new metastases or disappearance of metastases, or the change in the rate of growth or shrinking of a tumor, or development of new metastases or disappearance of metastases.

Any of a variety of detectable proteins can be detected in the monitoring methods provided herein; an exemplary, non-limiting list of such detectable proteins includes any of a variety of fluorescent proteins (e.g., green or red fluorescent proteins), any of a variety of luciferases, transferrin or other iron binding proteins; or receptors, binding proteins, and antibodies, where a compound that specifically binds the receptor, binding protein or antibody can be a detectable agent or can be labeled with a detectable substance (e.g., a radionuclide or imaging agent). Viruses expressing a detectable protein can be detected by a combination of the method provided herein and know in the art. Viruses expressing more than one detectable protein or two or more viruses expressing various detectable protein can be detected and distinguished by dual imaging methods. For example, a virus expressing a fluorescent protein and an iron binding protein can be detected in vitro or in vivo by low light fluorescence imaging and magnetic resonance, respectively. In another example, a virus expressing two or more fluorescent proteins can be detected by fluorescence imaging at different wavelength. In vivo dual imaging can be performed on a subject that has been administered a virus expressing two or more detectable gene products or two or more viruses each expressing one or more detectable gene products.

b. Monitoring Tumor Size

Also provided herein are methods of monitoring tumor and/or metastasis size and location. Tumor and or metastasis size can be monitored by any of a variety of methods known in the art, including external assessment methods or tomographic or magnetic imaging methods. In addition to the methods known in the art, methods provided herein, for example, monitoring viral gene expression, can be used for monitoring tumor and/or metastasis size.

Monitoring size over several time points can provide information regarding the increase or decrease in size of a tumor or metastasis, and can also provide information regarding the presence of additional tumors and/or metastases in the subject. Monitoring tumor size over several time points can provide information regarding the development of a neoplastic disease in a subject, including the efficacy of treatment of a neoplastic disease in a subject.

c. Monitoring Antibody Titer

The methods provided herein also can include monitoring the antibody titer in a subject, including antibodies produced in response to administration of a virus to a subject. The viruses administered in the methods provided herein can elicit an immune response to endogenous viral antigens. The viruses administered in the methods provided herein also can elicit an immune response to exogenous genes expressed by a virus. The viruses administered in the methods provided herein also can elicit an immune response to tumor antigens. Monitoring antibody titer against viral antigens, viral expressed exogenous gene products, or tumor antigens can be used in methods of monitoring the toxicity of a virus, monitoring the efficacy of treatment methods, or monitoring the level of gene product or antibodies for production and/or harvesting.

In one embodiment, monitoring antibody titer can be used to monitor the toxicity of a virus. Antibody titer against a virus can vary over the time period after administration of the virus to the subject, where at some particular time points, a low anti-(viral antigen) antibody titer can indicate a higher toxicity, while at other time points a high anti-(viral antigen) antibody titer can indicate a higher toxicity. The viruses used in the methods provided herein can be immunogenic, and can, therefore, elicit an immune response soon after administering the virus to the subject. Generally, a virus against which a subject's immune system can quickly mount a strong immune response can be a virus that has low toxicity when the subject's immune system can remove the virus from all normal organs or tissues. Thus, in some embodiments, a high antibody titer against viral antigens soon after administering the virus to a subject can indicate low toxicity of a virus. In contrast, a virus that is not highly immunogenic can infect a host organism without eliciting a strong immune response, which can result in a higher toxicity of the virus to the host. Accordingly, in some embodiments, a high antibody titer against viral antigens soon after administering the virus to a subject can indicate low toxicity of a virus.

In other embodiments, monitoring antibody titer can be used to monitor the efficacy of treatment methods. In the methods provided herein, antibody titer, such as anti-(tumor antigen) antibody titer, can indicate the efficacy of a therapeutic method such as a therapeutic method to treat neoplastic disease. Therapeutic methods provided herein can include causing or enhancing an immune response against a tumor and/or metastasis. Thus, by monitoring the anti-(tumor antigen) antibody titer, it is possible to monitor the efficacy of a therapeutic method in causing or enhancing an immune response against a tumor and/or metastasis. The therapeutic methods provided herein also can include administering to a subject a virus that can accumulate in a tumor and can cause or enhance an anti-tumor immune response. Accordingly, it is possible to monitor the ability of a host to mount an immune response against viruses accumulated in a tumor or metastasis, which can indicate that a subject has also mounted an anti-tumor immune response, or can indicate that a subject is likely to mount an anti-tumor immune response, or can indicate that a subject is capable of mounting an anti-tumor immune response.

In other embodiments, monitoring antibody titer can be used for monitoring the level of gene product or antibodies for production and/or harvesting. As provided herein, methods can be used for producing proteins, RNA molecules or other compounds by expressing an exogenous gene in a virus that has accumulated in a tumor. Further provided herein are methods for producing antibodies against a protein, RNA molecule or other compound produced by exogenous gene expression of a virus that has accumulated in a tumor. Monitoring antibody titer against the protein, RNA molecule or other compound can indicate the level of production of the protein, RNA molecule or other compound by the tumor-accumulated virus, and also can directly indicate the level of antibodies specific for such a protein, RNA molecule or other compound.

d. Monitoring General Health Diagnostics

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering to a subject a virus. Monitoring the health of a subject can be used to determine the pathogenicity of a virus administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

e. Monitoring Coordinated with Treatment

Also provided herein are methods of monitoring a therapy, where therapeutic decisions can be based on the results of the monitoring. Therapeutic methods provided herein can include administering to a subject a virus, where the virus can preferentially accumulate in a tumor and/or metastasis, and where the virus can cause or enhance an anti-tumor immune response. Such therapeutic methods can include a variety of steps including multiple administrations of a particular virus, administration of a second virus, or administration of a therapeutic compound. Determination of the amount, timing or type of virus or compound to administer to the subject can be based on one or more results from monitoring the subject. For example, the antibody titer in a subject can be used to determine whether or not it is desirable to administer a virus or compound, the quantity of virus or compound to administer, and the type of virus or compound to administer, where, for example, a low antibody titer can indicate the desirability of administering additional virus, a different virus, or a therapeutic compound such as a compound that induces viral gene expression. In another example, the overall health state of a subject can be used to determine whether or not it is desirable to administer a virus or compound, the quantity of virus or compound to administer, and the type of virus or compound to administer, where, for example, determining that the subject is healthy can indicate the desirability of administering additional virus, a different virus, or a therapeutic compound such as a compound that induces viral gene expression. In another example, monitoring a detectable virally expressed gene product can be used to determine whether or not it is desirable to administer a virus or compound, the quantity of virus or compound to administer, and the type of virus or compound to administer. Such monitoring methods can be used to determine whether or not the therapeutic method is effective, whether or not the therapeutic method is pathogenic to the subject, whether or not the virus has accumulated in a tumor or metastasis, and whether or not the virus has accumulated in normal tissues or organs. Based on such determinations, the desirability and form of further therapeutic methods can be derived.

In one embodiment, determination of whether or not a therapeutic method is effective can be used to derive further therapeutic methods. Any of a variety of methods of monitoring can be used to determine whether or not a therapeutic method is effective, as provided herein or otherwise known in the art. If monitoring methods indicate that the therapeutic method is effective, a decision can be made to maintain the current course of therapy, which can include further administrations of a virus or compound, or a decision can be made that no further administrations are required. If monitoring methods indicate that the therapeutic method is ineffective, the monitoring results can indicate whether or not a course of treatment should be discontinued (e.g., when a virus is pathogenic to the subject), or changed (e.g., when a virus accumulates in a tumor without harming the host organism, but without eliciting an anti-tumor immune response), or increased in frequency or amount (e.g., when little or no virus accumulates in tumor).

In one example, monitoring can indicate that a virus is pathogenic to a subject. In such instances, a decision can be made to terminate administration of the virus to the subject, to administer lower levels of the virus to the subject, to administer a different virus to a subject, or to administer to a subject a compound that reduces the pathogenicity of the virus. In one example, administration of a virus that is determined to be pathogenic can be terminated. In another example, the dosage amount of a virus that is determined to be pathogenic can be decreased for subsequent administration; in one version of such an example, the subject can be pre-treated with another virus that can increase the ability of the pathogenic virus to accumulate in tumor, prior to re-administering the pathogenic virus to the subject. In another example, a subject can have administered thereto a virus that is pathogenic to the subject; administration of such a pathogenic virus can be accompanied by administration of, for example, an antiviral compound (e.g., cidofovir), pathogenicity attenuating compound (e.g., a compound that down-regulates the expression of a lytic or apoptotic gene product), or other compound that can decrease the proliferation, toxicity, or cell killing properties of a virus, as described herein elsewhere. In one variation of such an example, the localization of the virus can be monitored, and, upon determination that the virus is accumulated in tumor and/or metastases but not in normal tissues or organs, administration of the antiviral compound or pathogenicity attenuating compound can be terminated, and the pathogenic activity of the virus can be activated or increased, but limited to the tumor and/or metastasis. In another variation of such an example, after terminating administration of the antiviral compound or pathogenicity attenuating compound, the presence of the virus and/or pathogenicity of the virus can be further monitored, and administration of such a compound can be reinitiated if the virus is determined to pose a threat to the host by, for example, spreading to normal organs or tissues, releasing a toxin into the vasculature, or otherwise having pathogenic effects reaching beyond the tumor or metastasis.

In another example, monitoring can determine whether or not a virus has accumulated in a tumor or metastasis of a subject. Upon such a determination, a decision can be made to further administer additional virus, a different virus or a compound to the subject. In another example, monitoring the presence of a virus in a tumor can be used in deciding to administer to the subject a compound, where the compound can increase the pathogenicity, proliferation, or immunogenicity of a virus or the compound can otherwise act in conjunction with the virus to increase the proliferation, toxicity, tumor cell killing, or immune response eliciting properties of a virus; in one variation of such an example, the virus can, for example, have little or no lytic or cell killing capability in the absence of such a compound; in a further variation of such an example, monitoring of the presence of the virus in a tumor or metastasis can be coupled with monitoring the absence of the virus in normal tissues or organs, where the compound is administered if the virus is present in tumor or metastasis and not at all present or substantially not present in normal organs or tissues; in a further variation of such an example, the amount of virus in a tumor or metastasis can be monitored, where the compound is administered if the virus is present in tumor or metastasis at sufficient levels.

H. METHODS OF PRODUCING GENE PRODUCTS AND ANTIBODIES

Provided herein are viruses and methods for making and using such viruses for production products of exogenous genes and/or for production of antibodies specific for exogenous gene products. The methods provided herein result in efficient recombinant production of biologically active proteins. As provided herein, a system based on the accumulation of viruses in tumors can be used for simple, quick, and inexpensive production of proteins and other biological compounds originating from cloned nucleotide sequences. This system also is useful for the concomitant overproduction of polypeptides, RNA or other biological compounds (in tumor tissue) and antibodies against those compounds (in the serum) in the same animal. These systems have the following advantages: (a) the viruses target the tumor specifically without affecting normal tissue; (b) the expression and secretion of the therapeutic gene constructs can be, optionally, under the control of an inducible promoter enabling secretion to be switched on or off; and (c) the location of the delivery system inside the tumor can be verified by direct visualization before activating gene expression and protein delivery.

As provided herein, after administration, a virus such as vaccinia virus can enter the tumor of an animal and, due to the immunoprivileged state of the tumor, can replicate preferentially in the tumor tissues and thereby can overproduce the inserted gene encoded protein in the tumors. After harvesting the tumor tissues, the localized and over-expressed protein can be isolated by a simple procedure from tumor homogenates. In addition, based on findings that only 0.2 to 0.3% of the desired proteins produced in the tumor are found in the blood stream of the same animal, a simultaneous vaccination of the mouse and efficient antibody production against the overproduced protein can be achieved. Thus, serum from the same mouse (or any other animal) can be harvested and used as mouse-derived antibodies against the proteins or other products overproduced in the tumor.

Thus, provided herein are methods of producing gene products and/or antibodies in a non-human subject, by administering to a subject containing a tumor, a virus, wherein the virus expresses a gene encoding a selected protein or RNA to be produced, a protein or RNA whose expression can result in the formation of a compound to be produced, or a selected protein or RNA against which an antibody is to be produced. The gene or genes expressed can be endogenous or exogenous to the virus. The nucleotide sequences can be contained in a recombinant virus containing appropriate expression cassettes. For example, the nucleotide sequences can be operatively linked with a promoter allowing high expression. Such promoters can include, for example, inducible promoters; a variety of such promoters are known to persons skilled in the art. Expression of the gene(s) can be regulated, for example, by a transcriptional activator or inducer, or a transcriptional suppressor. In one embodiment, the methods provided herein for producing a protein, RNA, compound or antibody can further include monitoring the localization and/or level of the virus in the subject by detecting a detectable protein, wherein the detectable protein can indicate the expression of the selected gene, or can indicate the readiness of the virus to be induced to express the selected gene or for suppression of expression of the gene to be terminated or suspended. In one embodiment, the virus contains a nucleotide sequence encoding a detectable protein, such as a luminescent or fluorescent protein, or a protein capable of inducing a detectable signal.

The virus can be administered to a transgenic animal or a non-transgenic animal. The subject can be selected according to its ability to post-translationally process the selected protein.

In one embodiment, methods are provided for producing a desired polypeptide, RNA or compound, the method including the following steps: (a) injecting a virus containing a nucleotide sequence encoding the desired polypeptide or RNA into an animal bearing a tumor; (b) harvesting the tumor tissue from the animal; and (c) isolating the desired polypeptide, RNA or compound from the tumor tissue.

Steps of an exemplary method can be summarized as follows (shown for a particular embodiment, for example a vaccinia virus, additionally containing a gene encoding a light-emitting protein):
(1) Insertion of the desired DNA or cDNA into the vaccinia virus genome;
(2) modification of the vaccinia virus genome with light-emitting protein construct as expression marker;
(3) recombination and virus assembly in cell culture;
(4) screening of individual viral particles carrying inserts followed by large scale virus production and concentration;
(5) administration of the viral particles into mice or other animals bearing tumors of human, non-human primate or other mammalian origins;
(6) verification of viral replication and protein overproduction in animals based on light emission;
(7) harvest of tumor tissues and, optionally, the blood (separately); and
(8) purification of over-expressed proteins from tumors and, optionally, antisera from blood using conventional methods.

Any viruses can be used in the methods provided herein, provided that they replicate in the animal, are not pathogenic for the animal, for example, are attenuated, and/or are recognized by the immune system of the animal. In some embodiments, such viruses also can express exogenous genes. Suitable viruses and cells are, for example, disclosed in EP A1 1 281 772 and EP A1 1 281 767. The person skilled in the art also knows how to generate animals carrying the desired tumor (see, for example, EP A1 1 281 767 or EP A1 1 281 777).

Also provided is a method for simultaneously producing a desired polypeptide, RNA or compound and an antibody directed to the polypeptide, RNA or compound, the method having the following steps: (a) administering a virus containing a nucleotide sequence encoding the desired polypeptide or RNA into an animal bearing a tumor; (b) harvesting the tumor tissue from the animal; (c) isolating the desired polypeptide, RNA or compound from the tumor tissue; and (d) isolating the antibody directed to the polypeptide, RNA or compound from the serum obtained from the animal. This approach can be used for generating polypeptides and/or antibodies against the polypeptides which are toxic or unstable, or which require species specific cellular environment for correct folding or modifications.

A person skilled in the art is familiar with a variety of viral expression vectors, which can be selected according to the virus used to infect the tumor, the cell type of the tumor, the organism to be infected, and other factors known in the art. Suitable viruses for use herein, include, but are not limited to, poxvirus, adenovirus, herpes simplex virus, Newcastle disease virus, vesicular stomatitis virus, mumps virus, influenza virus, measles virus, reovirus, human immunodeficiency virus, hanta virus, myoma virus, cytomegalovirus, and lentivirus. In some embodiments, virus can be a vaccinia virus, including the vaccinia viruses disclosed herein.

For generating protein or RNA-encoding nucleotide sequences and for constructing expression vectors or viruses that contain the nucleotide sequences, it is possible to use general methods known in the art. These methods include, for example, in vitro recombination techniques, synthetic methods and in vivo recombination methods as known in the art, and exemplified in Sambrook et al., Molecular Cloning, A Laboratory Manual, 2nd edition (1989) Cold Spring Harbor Laboratory Press, Cold Spring Harbor, N.Y.

In some embodiments, the protein or RNA to be produced in the tumor can be linked to an inducible promoter, such as a promoter that can be induced by a substance endogenous to the subject, or by a substance that can be administered to a subject. Accordingly, provided herein are methods of producing a protein or RNA in a tumor, where the production can be induced by administration of a substance to a subject, and, optionally, harvesting the tumor and isolating the protein or RNA from the tumor. Such induction methods can be coupled with methods of monitoring a virus in a subject. For example, a virus can be monitored by detecting a detectable protein. In methods that include monitoring, detection of a desired localization and/or level of virus in the subject can be coordinated with induction of viral gene expression. For example, when a virally expressed detectable protein is detected in tumor, but not appreciably in normal organs or tissues, an inducer can be administered to the subject. In another example, when a virally expressed detectable protein is detected in tumor, and also in normal organs or tissues, administration of an inducer can be suspended or postponed until the detectable protein is no longer detected in normal organs or tissues. In another example, when a virally expressed detectable protein is detected at sufficient levels in tumor, an inducer can be administered to the subject. In another example, when a virally expressed detectable protein is not detected at sufficient levels in tumor administration of an inducer can be suspended or postponed until the detectable protein is detected at sufficient levels in the tumor.

Also provided herein are methods of producing a protein or RNA in a tumor, by administering a virus encoding the protein or RNA, and a suppressor of gene expression. The suppressor of gene expression can be administered for a predefined period of time, or until the virus accumulates in tumor but not in normal organs or tissues, or until sufficient levels of the virus have accumulated in the tumor, at which point administration of the suppressor can be terminated or suspended, which can result in expression of the protein or RNA.

As will be recognized by one skilled in the art, methods similar to those provided herein in regard to monitoring a detectable protein and administering an inducer, can also apply for terminating or suspending administration of a suppressor.

Any of a variety of animals, including laboratory or livestock animals can be used, including for example, mice, rats and other rodents, rabbits, guinea pigs, pigs, sheep, goats, cows and horses. Exemplary animals are mice. The tumor can be generated by implanting tumor cells into the animal. Generally, for the production of a desired polypeptide, RNA, or compound, any solid tumor type can be used, such as a fast growing tumor type. Exemplary fast growing tumor types include C6 rat glioma and HCT116 human colon carcinoma. Generally, for the production of a desired antibody, a relatively slow growing tumor type can be used. Exemplary slow growing tumor types include HT1080 human fibrosarcoma and GI-101A human breast carcinoma. For T-independent antibody production, nu$^-$/nu$^-$ mice bearing allogenic tumor or xenografts can be used; while for T-dependent antibody production, immunocompetent mice with syngenic tumors can be used. In some embodiments, such as where the compound to be produced is a protein, the virus selected can be a virus that uses the translational components (e.g., proteins, vesicles, substrates) of the tumor cells, such as, for example, a virus that uses the translational components of a tumor cell. In such instances, the tumor cell type can be selected according to the desired post-translational processing to be performed on the protein, including proteolysis, glycosylation, lipidylation, disulfide formation, and any refolding or multimer assembly that can require cellular components for completing. In some examples, the tumor cell type selected can be the same species as the protein to be expressed, thus resulting in species-specific post-translational processing of the protein; an exemplary tumor cell type-expressed protein species is human.

1. Production of Recombinant Proteins and RNA Molecules

The tumor tissue can be surgically removed from the animal. After homogenization of the tumor tissue, the desired polypeptide, RNA or other biological compound can be purified according to established methods. For example, in the case of a recombinant polypeptide, the polypeptide might contain a bindable tag such as a his-tag, and can be purified, for example, via column chromatography. The time necessary for accumulation of sufficient amounts of the polypeptide or RNA in the tumor of the animal depends on many factors, for example, the kind of animal or the kind of tumor, and can be determined by the skilled person by routine experimentation. In general, expression of the desired polypeptide can be detected two days after virus injection. The expression peaks approximately two weeks after injection, and lasts up to two months. In some embodiments, the amount of desired polypeptide or RNA in the tumor can be determined by monitoring a virally expressed detectable substance, where the concentration of the detectable substance can reflect the amount of desired polypeptide or RNA in the tumor.

In another embodiment, the desired polypeptide, RNA or other compound can be manufactured in the subject, and provide a beneficial effect to the subject. In one example, a virus can encode a protein or RNA, or a protein that manufactures a compound that is not manufactured by the subject. In one example, a virus can encode a peptide hormone or cytokine, such as insulin, which can be released into the vasculature of a subject lacking the ability to produce insulin or requiring increased insulin concentrations in the vasculature. In another example, blood clotting factors can be manufactured in a subject with blood clotting deficiency, such as a hemophiliac. In some embodiments, the protein or RNA to be produced in the tumor can be linked to an inducible promoter, such as a promoter that can be induced by increased glucose concentrations. In such instances, the manufacture of the protein or RNA can be controlled in response to one or more substances in the subject or by one or more substances that can be administered to a subject, such as a compound that can induce transcription, for example, RU486. Thus, in some embodiments, the methods provided herein can include administering to a subject having a tumor, a virus that can express one or more genes encoding a beneficial gene product or a gene product that can manufacture a beneficial compound.

2. Production of Antibodies

Also provided are methods for producing a desired antibody, the method comprising the following steps: (a) administering a virus containing a nucleotide sequence encoding an antigen into an animal bearing a tumor; and (b) isolating the antibody directed to the antigen from the serum obtained from the animal. The antibodies directed to the antigen can be isolated and purified according to well known methods. Antibodies that are directed against specific contaminating antigens can be removed by adsorption, and the antibodies directed against the target antigen can be separated from contaminating antibodies by affinity purification, for example, by immunoaffinity chromatography using the recombinant antigen as the ligand of the column, by methods known in the art. Antibodies can be collected from the animal in a single harvest, or can be collected over time by collection bleeds, as is known in the art.

K. EXAMPLES

The following examples are included for illustrative purposes only and are not intended to limit the scope of the invention.

Example 1

Generation of Modified Vaccinia Virus Strains

A. Construction of Modified Vaccinia Viruses

Modified vaccinia viruses were generated by replacing nucleic acid or inserting nucleic acid at several loci in the vaccinia virus genome as follows: the F14.5L (also referred to as F3; see U.S. Patent Publication No. 2005/0031643), thymidine kinase (TK), hemagglutinin (HA) and A34R gene loci (the A34R gene encodes a C-type lectin-like glycoprotein, gp22-24, that is present in the outer membrane of extracellular enveloped virus (EEV), and that is reported to be required for infectivity of EEV; see, e.g., McIntosh et al. (1996) *J. Virol.* 70:272-281). The heterologous DNA inserted either was (1) a relatively short non-coding DNA fragment, (2) an expression cassette containing protein-encoding DNA operably linked in the correct or reverse orientation to a vaccinia virus promoter, or (3) the coding sequence of the A34R gene (SEQ ID NO: 58) from vaccinia virus strain IHD-J.

The starting strain for the modified vaccinia viruses described herein was vaccinia virus (VV) strain GLV-1h68 (also named RVGL21, SEQ ID NO: 1). This genetically engineered strain, which has been described in U.S. Patent Publication No. 2005/0031643, contains DNA insertions in the F14.5L, thymidine kinase (TK) and hemagglutinin (HA) genes. GLV-1h68 was prepared from the vaccinia virus strain designated LIVP (a vaccinia virus strain, originally derived by adapting the Lister strain (ATCC Catalog No. VR-1549) to calf skin (Research Institute of Viral Preparations, Moscow, Russia, Al'tshtein et al. (1983) *Dokl. Akad. Nauk USSR* 285: 696-699). The LIVP strain (whose genome sequence is set forth in SEQ ID NO: 2), from which GLV-1h68 was generated, contains a mutation in the coding sequence of the TK gene (see SEQ ID NO: 2 for the sequence of the LIVP strain) in which a substitution of a guanine nucleotide with a thymidine nucleotide (nucleotide position 80207 of SEQ ID NO: 2) introduces a premature STOP codon within the coding sequence.

As described in U.S. Patent Publication No. 2005/0031643 (see particularly Example 1 of the application), GLV-1h68 was generated by inserting expression cassettes encoding detectable marker proteins into the F14.5L (also designated in LIVP as F3) gene, thymidine kinase (TK) gene, and hemagglutinin (HA) gene loci of the vaccinia virus LIVP strain. Specifically, an expression cassette containing a Ruc-GFP cDNA (a fusion of DNA encoding *Renilla* luciferase and DNA encoding GFP) under the control of a vaccinia synthetic early/late promoter $P_{SEL}$ was inserted into the F14.5L gene; an expression cassette containing DNA encoding beta-galactosidase under the control of the vaccinia early/late promoter $P_{7.5k}$ (denoted ($P_{7.5k}$)LacZ) and DNA encoding a rat transferrin receptor positioned in the reverse orientation for transcription relative to the vaccinia synthetic early/late promoter $P_{SEL}$ (denoted ($P_{SEL}$)rTrfR) was inserted into the TK gene (the resulting virus does not express transferrin receptor protein since the DNA encoding the protein is positioned in the reverse orientation for transcription relative to the promoter in the cassette); and an expression cassette containing DNA encoding β-glucuronidase under the control of the vaccinia late promoter $P_{11k}$ (denoted ($P_{11k}$)gusA) was inserted into the HA gene. Another genetically engineered vaccinia strain, designated GLV-1h22 was produced that has essentially the same genotype as GLV-1h68, with the exception that, in the expression cassette inserted into the TK gene (SEQ ID NO: 3), the DNA encoding the rat transferrin receptor is in the correct orientation for transcription from the vaccinia synthetic early/late promoter $P_{SEL}$. GLV-1h22 was constructed using the same method as used to create GLV-1h68, which is described in detail in U.S. Patent Publication No. 2005/0031643, with exception that the expression cassette inserted into the TK locus was generated using the pSC65-TfR transfer vector (also described in U.S. Patent Publication No. 2005/0031643; the parent vector for GLV-1h22 is RVGL19, which is shown in FIG. 1 and described in Example 1 of U.S. Patent Publication No. 2005/0031643).

Insertion of the expression cassettes into the LIVP genome in the generation of strains GLV-1h68 and GLV-1h22 resulted in disruption of the coding sequences for each of the F14.5L, TK and HA genes; accordingly, all three genes in the resulting strains are nonfunctional in that they do not encode the corresponding full-length proteins. As described in U.S. Patent Publication No. 2005/0031643, disruption of these genes not only attenuates the virus but also enhances its tumor-specific accumulation. Previous data have shown that systemic delivery of the GLV-1h68 virus in a mouse model of breast cancer resulted in the complete eradication of large subcutaneous GI-101A human breast carcinoma xenograft tumors in nude mice (see U.S. Patent Publication No. 2005/0031643).

1. Modified Viral Strains

Modified recombinant vaccinia viruses containing heterologous DNA inserted into one or more loci of the vaccinia virus genome were generated via homologous recombination between DNA sequences in the genome and a transfer vector using methods described herein and known to those of skill in the art (see, e.g., Falkner and Moss (1990) *J. Virol.* 64:3108-2111; Chakrabarti et al. (1985) *Mol. Cell Biol.* 5:3403-3409; and U.S. Pat. No. 4,722,848). In these methods, the existing target gene in the starting vaccinia virus genome is replaced by an interrupted copy of the gene contained in the transfer vector through two crossover events: a first crossover event of homologous recombination between the vaccinia virus genome and the transfer vector and a second crossover event of homologous recombination between direct repeats within the target locus. The interrupted version of the target gene that is in the transfer vector contains the insertion DNA flanked on each side by DNA corresponding to the left portion of the target gene and right portion of the target gene, respectively. The transfer vector also contains a dominant selection marker, e.g., the *E. coli* guanine phosphoribosyltransferase (gpt) gene, under the control of a vaccinia virus early promoter (e.g., $P_{7.5kE}$). Including such a marker in the vector enables a transient dominant selection process to identify recombinant virus grown under selective pressure that has incorporated the transfer vector within its genome. Because the marker gene is not stably integrated into the genome, it is deleted from the genome in a second crossover event that occurs when selection is removed. Thus, the final recombinant virus contains the interrupted version of the target gene as a disruption of the target loci, but does not retain the selectable marker from the transfer vector.

Homologous recombination between a transfer vector and a starting vaccinia virus genome occurred upon introduction of the transfer vector into cells that have been infected with the starting vaccinia virus. A series of transfer vectors was constructed as described below and the following modified vaccinia strains were constructed: GLV-1i69, GLV-1h70, GLV-1h71, GLV-1h72, GLV-1h73, GLV-1h74, GLV-1h81, GLV-1h82, GLV-1h83, GLV-1h84, GLV-1h85, GLV-1h86, GLV-1j87, GLV-1j88, GLV-1j89, GLV-1h90, GLV-1h91, GLV-1h92, GLV-1h96, GLV-1h97, GLV-1h98, GLV-1h104, GLV-1h105, GLV-1h106, GLV-1h107, GLV-1h108 and GLV-1h109. The construction of these strains is summarized in the following Table, which lists the modified vaccinia virus strains, including the previously described GLV-1h68, their respective genotypes, and the transfer vectors used to engineer the viruses:

TABLE 2

Generation of engineered vaccinia viruses

| Name of Virus | Parental Virus | VV Transfer Vector | Genotype |
| --- | --- | --- | --- |
| GLV-1h68 | — | — | F14.5L: ($P_{SEL}$)Ruc-GFP<br>TK: ($P_{SEL}$)rTrfR-($P_{7.5k}$)LacZ<br>HA: ($P_{11k}$)gusA |
| GLV-1i69 | GLV-1h68 | A34R gene from VV IHD-J | F14.5L: ($P_{SEL}$)Ruc-GFP<br>TK: ($P_{SEL}$)rTrfR-($P_{7.5k}$)LacZ<br>HA: ($P_{11k}$)gusA<br>A34R: A34R-IHD-J |

TABLE 2-continued

Generation of engineered vaccinia viruses

| Name of Virus | Parental Virus | VV Transfer Vector | Genotype |
|---|---|---|---|
| GLV-1h70 | GLV-1h68 | pNCVVhaT | F14.5L: ($P_{SEL}$)Ruc-GFP<br>TK: ($P_{SEL}$)rTrfR-($P_{7.5k}$)LacZ<br>HA: HindIII-BamHI |
| GLV-1h71 | GLV-1h68 | pNCVVf14.5lT | F14.5L: BamHI-HindIII<br>TK: ($P_{SEL}$)rTrfR-($P_{7.5k}$)LacZ<br>HA: ($P_{11k}$)gusA |
| GLV-1h72 | GLV-1h68 | pCR-TKLR-gpt2 | F14.5L: ($P_{SEL}$)Ruc-GFP<br>TK: SacI-BamHI<br>HA: ($P_{11k}$)gusA |
| GLV-1h73 | GLV-1h70 | pNCVVf14.5lT | F14.5L: BamHI-HindIII<br>TK: ($P_{SEL}$)rTrfR-($P_{7.5k}$)LacZ<br>HA: HindIII-BamHI |
| GLV-1h74 | GLV-1h73 | pCR-TKLR-gpt2 | F14.5L: BamHI-Hind III<br>TK: SacI-BamHI<br>HA: HindIII-BamHI |
| GLV-1h81 | GLV-1h68 | pNCVVhaT-SEL-hk5 | F14.5L: ($P_{SEL}$)Ruc-GFP<br>TK: ($P_{SEL}$)rTrfR-($P_{7.5k}$)LacZ<br>HA: ($P_{SEL}$)hk-5 |
| GLV-1h82 | GLV-1h22 | pNCVVhaT-ftn | F14.5L: ($P_{SEL}$)Ruc-GFP<br>TK: ($P_{SEL}$)TrfR-($P_{7.5k}$)LacZ<br>HA: ($P_{SEL}$)ftn |
| GLV-1h83 | GLV-1h68 | pNCVVhaT-ftn | F14.5L: ($P_{SEL}$)Ruc-GFP<br>TK: ($P_{SEL}$)rTrfR-($P_{7.5k}$)LacZ<br>HA: ($P_{SEL}$)ftn |
| GLV-1h84 | GLV-1h73 | pCR-TK-SEL-mRFP1 | F14.5L: BamHI-Hind III<br>TK: ($P_{SEL}$)CBG99-mRFP1<br>HA: Hind III-BamHI |
| GLV-1h85 | GLV-1h72 | pNCVVf14.5lT | F14.5L: BamHI-HindIII<br>TK: Sac I-BamHI<br>HA: ($P_{11k}$)gusA |
| GLV-1h86 | GLV-1h72 | pNCVVhaT | F14.5L: ($P_{SEL}$)Ruc-GFP<br>TK: Sac I-BamHI<br>HA: Hind III-BamHI |
| GLV-1j87 | GLV-1h68 | pCR-gpt-dA35R6 | F14.5L: ($P_{SEL}$)Ruc-GFP<br>TK: ($P_{SEL}$)rTrfR-($P_{7.5k}$)LacZ<br>HA: ($P_{11k}$)gusA<br>A35R: Multiple cloning sites (MCS) |
| GLV-1j88 | GLV-1h73 | pCR-gpt-dA35R6 | F14.5L: BamHI-HindIII<br>TK: ($P_{SEL}$)rTrfR-($P_{7.5k}$)LacZ<br>HA: HindIII-BamHI<br>A35R: MCS |
| GLV-1j89 | GLV-1h74 | pCR-gpt-dA35R6 | F14.5L: BamHI-HindIII<br>TK: SacI-BamHI<br>HA: HindIII-BamHI<br>A35R: MCS |
| GLV-1h90 | GLV-1h68 | HA-SE-IL-6-1 | F14.5L: ($P_{SEL}$)Ruc-GFP<br>TK: ($P_{SEL}$)rTrfR-($P_{7.5k}$)LacZ<br>HA: ($P_{SE}$)sIL-6R/IL-6 |
| GLV-1h91 | GLV-1h68 | HA-SEL-IL-6-1 | F14.5L: ($P_{SEL}$)Ruc-GFP<br>TK: ($P_{SEL}$)rTrfR-($P_{7.5k}$)LacZ<br>HA: ($P_{SEL}$)sIL-6R/IL-6 |
| GLV-1h92 | GLV-1h68 | HA-SL-IL-6-1 | F14.5L: ($P_{SEL}$)Ruc-GFP<br>TK: ($P_{SEL}$)rTrfR-($P_{7.5k}$)LacZ<br>HA: ($P_{SL}$)sIL-6R/IL-6 |
| GLV-1h96 | GLV-1h68 | FSE-IL-24 | F14.5L: ($P_{SE}$)IL-24<br>TK: ($P_{SEL}$)rTrfR-($P_{7.5k}$)LacZ<br>HA: ($P_{11k}$)gusA |
| GLV-1h97 | GLV-1h68 | FSEL-IL-24 | F14.5L: ($P_{SEL}$)IL-24<br>TK: ($P_{SEL}$)rTrfR-($P_{7.5k}$)LacZ<br>HA: ($P_{11k}$)gusA |
| GLV-1h98 | GLV-1h68 | FSL-IL-24 | F14.5L: ($P_{SL}$)IL-24<br>TK: ($P_{SEL}$)rTrfR-($P_{7.5k}$)LacZ<br>HA: ($P_{11k}$)gusA |
| GLV-1h104 | GLV-1h68 | pCR-TK-SE-tTF-RGD | F14.5L: ($P_{SEL}$)Ruc-GFP<br>TK: ($P_{SE}$)tTF-RGD<br>HA: ($P_{11k}$)gusA |
| GLV-1h105 | GLV-1h68 | pCR-TK-SEL-tTF-RGD | F14.5L: ($P_{SEL}$)Ruc-GFP<br>TK: ($P_{SEL}$)tTF-RGD<br>HA: ($P_{11k}$)gusA |
| GLV-1h106 | GLV-1h68 | pCR-TK-SL-tTF-RGD | F14.5L: ($P_{SEL}$)Ruc-GFP<br>TK: ($P_{SL}$)tTF-RGD<br>HA: ($P_{11k}$)gusA |
| GLV-1h107 | GLV-1h68 | pCR-TK-SE-G6-FLAG | F14.5L: ($P_{SEL}$)Ruc-GFP<br>TK: ($P_{SE}$)G6-FLAG<br>HA: ($P_{11k}$)gusA |

TABLE 2-continued

Generation of engineered vaccinia viruses

| Name of Virus | Parental Virus | VV Transfer Vector | Genotype |
|---|---|---|---|
| GLV-1h108 | GLV-1h68 | pCR-TK-SEL-G6-FLAG | F14.5L: ($P_{SEL}$)Ruc-GFP<br>TK: ($P_{SEL}$)G6-FLAG<br>HA: ($P_{11k}$)gusA |
| GLV-1h109 | GLV-1h68 | pCR-TK-SL-G6-FLAG | F14.5L: ($P_{SEL}$)Ruc-GFP<br>TK: ($P_{SL}$)G6-FLAG<br>HA: ($P_{11k}$)gusA |

Briefly, these strains were generated as follows (further details are provided below):

GLV-1i69 was generated by replacement of the coding sequence of the A34R gene in starting strain GLV-1h68 (nucleotides 153693 to 154199 in SEQ ID NO: 1) with the A34R gene from well-known vaccinia virus IHD-J strain.

GLV-1h70 was generated by insertion of a short non-coding DNA fragment containing HindIII and BamHI sites into the HA locus of starting strain GLV-1h68 thereby deleting the gusA expression cassette at the HA locus of GLV-1h68. Thus, in strain GLV-1h70, the vaccinia HA gene is interrupted within the coding sequence by a short non-coding DNA fragment.

GLV-1h71 was generated by insertion of a short non-coding DNA fragment containing BamHI and HindIII sites (SEQ ID NO: 12) into the F14.5L locus of starting strain GLV-1h68 thereby deleting the Ruc-GFP fusion gene expression cassette at the F14.5L locus of GLV-1h68. Thus, in strain GLV-1h71, the vaccinia F14.5L gene is interrupted within the coding sequence by a short non-coding DNA fragment.

GLV-1h72 was generated by insertion of a short non-coding DNA fragment containing SacI and BamHI sites (SEQ ID NO: 18) into the TK locus of starting strain GLV-1h68 thereby deleting the LacZ/rTFr expression cassette at the TK locus in GLV-1h68. Thus, in strain GLV-1h72, the vaccinia TK gene is interrupted within the coding sequence by a short non-coding DNA fragment.

GLV-1h73 was generated by insertion of a short non-coding DNA fragment containing BamHI and HindIII sites (SEQ ID NO: 12) into the F14.5L locus of GLV-1h70 thereby deleting the Ruc-GFP fusion gene expression cassette at the F14.5L locus of GLV-1h70. Thus, in strain GLV-1h73, the vaccinia HA and F14.5L genes are interrupted within the coding sequence by a short non-coding DNA fragment.

GLV-1h74 was generated by insertion of a short non-coding DNA fragment containing SacI and BamHI sites (SEQ ID NO: 18) into the TK locus of strain GLV-1h73 thereby deleting the LacZ/rTFr expression cassette at the TK locus of GLV-1h73. Thus, in strain GLV-1h74, the vaccinia HA, F14.5L and TK genes are interrupted within the coding sequence by a short non-coding DNA fragment.

GLV-1h81 was generated by insertion of an expression cassette encoding the plasminogen K5 domain under the control of the vaccinia $P_{SEL}$ promoter into the HA locus of starting strain GLV-1h68 thereby deleting the gusA expression cassette at the HA locus of starting GLV-1h68. Thus, in strain GLV-1h81, the vaccinia HA gene is interrupted within the coding sequence by a DNA fragment containing DNA encoding the plasminogen K5 domain operably linked to the vaccinia synthetic early/late promoter.

GLV-1h82 was generated by insertion of an expression cassette encoding E. coli ferritin under the control of the vaccinia $P_{SEL}$ promoter into the HA locus of strain GLV-1h22 thereby deleting the gusA expression cassette at the HA locus of GLV-1h22. Thus, in strain GLV-1h82, the vaccinia HA gene is interrupted within the coding sequence by a DNA fragment containing DNA encoding E. coli ferritin operably linked to the vaccinia synthetic early/late promoter GLV-1h83 was generated by insertion of an expression cassette encoding E. coli ferritin under the control of the vaccinia $P_{SEL}$ promoter into the HA locus of starting strain GLV-1h68 thereby deleting the gusA expression cassette at the HA locus of GLV-1h68. Thus, in strain GLV-1h83, the vaccinia HA gene is interrupted within the coding sequence by a DNA fragment containing DNA encoding E. coli ferritin operably linked to the vaccinia synthetic early/late promoter.

GLV-1h84 was generated by insertion of an expression cassette containing DNA encoding CBG99 and mRFP1 connected through a picornavirus 2A element and under the contrl of the vaccinia synthetic early/late promoter ($P_{SEL}$) in the TK locus of strain GLV-1h73 thereby deleting the LacZ/rTFr expression cassette at the TK locus of GLV-1h73. Thus, in strain GLV-1h84, the vaccinia HA and F14.5L genes are interrupted within the coding sequence by a short non-coding DNA fragment, and the vaccinia TK gene is interrupted within the coding sequence by DNA encoding a fusion of CBG99 and mRFP1 proteins. Since DNAs encoding both marker proteins (CBG99 and mRFP1) are under the control of the same promoter, only one transcript is produced. During translation, these two proteins are cleaved into two individual proteins at picornavirus 2A element (Osborn et al., Mol. Ther. 12: 569-74, 2005). CBG99 produces a more stable luminescent signal than does Renilla luciferase with a half-life of greater than 30 minutes, which makes both in vitro and in vivo assays more convenient. mRFP1 provides improvements in in vivo imaging relative to GFP since mRFP1 can penetrate tissue deeper than GFP.

GLV-1h85 was generated by insertion of a short non-coding DNA fragment containing BamHI and HindIII sites into the F14.5L locus of strain GLV-1h72 thereby deleting the Ruc-GFP fusion gene expression cassette at the F14.5L locus of GLV-1h72. Thus, in strain GLV-1h85, the vaccinia F14.5L and TK genes are interrupted within the coding sequence by a short non-coding DNA fragment.

GLV-1h86 was generated by insertion of a short non-coding DNA fragment containing HindIII and BamHI sites into the HA locus of strain GLV-1h72 thereby deleting the gusA expression cassette at the HA locus of GLV-1h72. Thus, in strain GLV-1h86, the vaccinia TK and HA genes are interrupted within the coding sequence by a short non-coding DNA fragment.

GLV-1j87 was generated by deletion the coding sequence of the A35R gene in starting strain GLV-1h68 (nucleotides 154,243 to 154,773 in SEQ ID NO: 1). Thus, in strain GLV-1j87, the vaccinia A35 gene is replaced by a short non-coding DNA fragment.

GLV-1j88 was generated by deletion the coding sequence of the A35R gene in starting strain GLV-1h73. Thus, in strain GLV-1j88, the vacciniaA35 gene is replaced by a short non-coding DNA fragment.

GLV-1j89 was generated by deletion the coding sequence of the A35R gene in starting strain GLV-1h74. Thus, in strain GLV-1j89, the vaccinia A35 gene is replaced by a short non-coding DNA fragment.

GLV-1h90 was generated by insertion of an expression cassette encoding human IL-6 fused to the 3' end of the cDNA encoding human soluble IL-6 receptor (sIL-6R, aa 1-323) under the control of the vaccinia $P_{SE}$ promoter into the HA locus of starting strain GLV-1h68, thereby deleting the gusA expression cassette at the HA locus of starting GLV-1h68. Thus, in strain GLV-1h90, the vaccinia HA gene is interrupted within the coding sequence by a DNA fragment containing DNA encoding human IL-6 fused to the 3' end of the cDNA encoding human soluble IL-6 receptor operably linked to the vaccinia synthetic early promoter.

GLV-1h91 was generated by insertion of an expression cassette encoding sIL-6R under the control of the vaccinia $P_{SEL}$ promoter into the HA locus of starting strain GLV-1h68, thereby deleting the gusA expression cassette at the HA locus of starting GLV-1h68. Thus, in strain GLV-1h91, the vaccinia HA gene is interrupted within the coding sequence by a DNA fragment containing DNA encoding human IL-6 fused to the 3' end of the cDNA encoding human soluble IL-6 receptor operably linked to the vaccinia synthetic early/late promoter.

GLV-1h92 was generated by insertion of an expression cassette encoding sIL-6R under the control of the vaccinia $P_{SL}$ promoter into the HA locus of starting strain GLV-1h68, thereby deleting the gusA expression cassette at the HA locus of starting GLV-1h68. Thus, in strain GLV-1h92, the vaccinia HA gene is interrupted within the coding sequence by a DNA fragment containing DNA encoding human IL-6 fused to the 3' end of the cDNA encoding human soluble IL-6 receptor operably linked to the vaccinia synthetic late promoter.

GLV-1h96 was generated by insertion of an expression cassette encoding the IL-24 under the control of the vaccinia $P_{SE}$ promoter into the F14.5L locus of starting strain GLV-1h68, thereby deleting the Ruc-GFP fusion gene expression cassette at the F14.5L locus of GLV-1h68. Thus, in strain GLV-1h96, the vaccinia F14.5L gene is interrupted within the coding sequence by a DNA fragment containing DNA encoding IL-24 operably linked to the vaccinia synthetic early promoter.

GLV-1h97 was generated by insertion of an expression cassette encoding IL-24 under the control of the vaccinia $P_{SEL}$ promoter into the F14.5L locus of starting strain GLV-1h68, thereby deleting the Ruc-GFP fusion gene expression cassette at the F14.5L locus of GLV-1h68. Thus, in strain GLV-1h97, the vaccinia F14.5L gene is interrupted within the coding sequence by a DNA fragment containing DNA encoding FCU operably linked to the vaccinia synthetic early/late promoter.

GLV-1h98 was generated by insertion of an expression cassette encoding IL-24 under the control of the vaccinia $P_{SL}$ promoter into the F14.5L locus of starting strain GLV-1h68, thereby deleting the Ruc-GFP fusion gene expression cassette at the F14.5L locus of GLV-1h68. Thus, in strain GLV-1h98, the vaccinia F14.5L gene is interrupted within the coding sequence by a DNA fragment containing DNA encoding IL-24 operably linked to the vaccinia synthetic late promoter.

GLV-1h104 was generated by insertion of an expression cassette containing DNA encoding truncated human tissue factor fused to the $\alpha_v\beta_3$-integrin RGD binding motif (tTF-RGD) under the control of the vaccinia synthetic early promoter ($P_{SE}$) into the TK locus of strain GLV-1h68 thereby deleting the LacZ/rTFr expression cassette at the TK locus of GLV-1h68. Strain GLV-1h104 retains the Ruc-GFP expression cassette at the F14.5L locus and the gusA expression cassette at the HA locus.

GLV-1h105 was generated by insertion of an expression cassette containing DNA encoding tTF-RGD fusion protein under the control of the vaccinia synthetic early/late promoter ($P_{SEL}$) into the TK locus of strain GLV-1h68 thereby deleting the LacZ/rTFr expression cassette at the TK locus of GLV-1h68. Strain GLV-1h105 retains the Ruc-GFP expression cassette at the F14.5L locus and the gusA expression cassette at the HA locus.

GLV-1h106 was generated by insertion of an expression cassette containing DNA encoding tTF-RGD fusion protein under the control of the vaccinia synthetic late promoter ($P_{SL}$) into the TK locus of strain GLV-1h68 thereby deleting the LacZ/rTFr expression cassette at the TK locus of GLV-1h68. Strain GLV-1h106 retains the Ruc-GFP expression cassette at the F14.5L locus and the gusA expression cassette at the HA locus.

GLV-1h107 was generated by insertion of an expression cassette containing DNA encoding scFv anti-VEGF-FLAG fusion protein (G6-FLAG) under the control of the vaccinia synthetic early promoter ($P_{SE}$) into the TK locus of strain GLV-1h68 therby deleting the LacZ/rTFr expression cassette at the TK locus of GLV-1h68. Strain GLV-1h107 retains the Ruc-GFP expression cassette at the F14.5L locus and the gusA expression cassette at the HA locus.

GLV-1h108 was generated by insertion of an expression cassette containing DNA encoding G6-FLAG fusion protein under the control of the vaccinia synthetic early/late promoter ($P_{SEL}$) into the TK locus of strain GLV-1h68 thereby deleting the LacZ/rTFr expression cassette at the TK locus of GLV-1h68. Strain GLV-1h108 retains the Ruc-GFP expression cassette at the F14.5L locus and the gusA expression cassette at the HA locus.

GLV-1h109 was generated by insertion of an expression cassette containing DNA encoding G6-FLAG fusion protein under the control of the vaccinia synthetic late promoter (PsL) into the TK locus of strain GLV-1h68 thereby deleting the LacZ/rTFr expression cassette at the TK locus of GLV-1h68. Strain GLV-1h109 retains the Ruc-GFP expression cassette at the F14.5L locus and the gusA expression cassette at the HA locus.

2. VV Transfer Vectors Employed for the Production of Modified Vaccinia Viruses

The following vectors were constructed and employed as described below to generate the recombinant vaccinia viral strains.

a. pNCVVhaT: For Insertion of Non-Coding Heterologous DNA into the Vaccinia Virus HA Locus The pNCVVhaT vector (SEQ ID NO: 4) was employed to create vaccinia virus strains GLV-1h70 and GLV-1h86 having the following genotypes: F14.5L: ($P_{SEL}$)Ruc-GFP, TK: ($P_{SEL}$)rTrfR-($P_{7.5k}$)LacZ (strain GLV-1h70), HA: HindIII-BamHI and F14.5L: ($P_{SEL}$)Ruc-GFP, TK: SacI-BamHI, HA: HindIII-BamHI (strain GLV-1h86). Strains GLV-1h70 and GLV-1h86 were generated by inserting a short non-coding DNA fragment containing HindIII and BamHI sites (SEQ ID NO: 5; taagcttcgcaggatccc) into the HA locus of strains GLV-1h68 and GLV-1h72, respectively, thereby deleting the gusA expression cassette at the hemagglutinin (HA) locus of GLV-1h68 and GLV-1h72. Vector pNCVVhaT contains the non-coding DNA fragment flanked by sequences of the HA gene, the E. coli guanine phosphoribosyltransferase (gpt) gene under the control of the vaccinia virus $P_{7.5kE}$ promoter for transient dominant selection of virus that has incorporated the vector, and sequences of the pUC plasmid. The left and right flanking sequences of the VV HA gene (also named A56R, see nucleotides 161420 to 162352 of SEQ ID NO: 2) that were incorporated into the vector correspond to nucleotides 161423 to 161923 and nucleotides 162037 to 162394, respectively of SEQ ID NO: 2. The HA gene flanking DNAs were PCR-amplified from VV LIVP using Platinum PCR SuperMix High Fidelity (Invitrogen, Carlsbad, Calif.) and the following primers containing the non-coding DNA sequence:

```
                                     (SEQ ID NO: 6)
Left flank:
5'-GCGCATATGACACGATTACCAATACTTTTG-3'
and (SEQ ID NO: 7)
5'-GTCGGGATCCTGCGAAGCTTAGATTTCGAATACCGACGAGC-3', (SEQ ID NO: 8)
Right Flank:
5'-GAAATCTAAGCTTCGCAGGATCCCGACTCCGGAACCAATTACTG-3'
and (SEQ ID NO: 9)
5'-GCGGAATTCTGATAGATTTTACTATCCCAG-3'.
```

The two fragments were joined using the method of gene-splicing by overlapping extension (see, e.g., Horton et al., *Methods Enzymol.,* 217:270-279 (1993)). The resulting fragment was digested with NdeI and EcoRI and cloned into the same-cut vector pUCP7.5-gpt-1 (SEQ ID NO: 10) to generate the construct pNCVVhaT. The flanking sequences of HA in the target vector were confirmed by sequencing and were identical to nucleotides 161423 to 161923 of SEQ ID NO: 2 (left flank) and nucleotides 162037 to 162394 of SEQ ID NO: 2 (right flank).

b. pNCVVf14.5lT: For Insertion of Non-Coding Heterologous DNA into the Vaccinia F14.5L Locus The pNCVVf14.5lT vector (SEQ ID NO: 11) was employed to create vaccinia virus strains GLV-1h71, GLV-1h73 and GLV-1h85 having the following genotypes: F14.5L: BamHI-HindIII, TK: ($P_{SEL}$)rTrfR-($P_{7.5k}$)LacZ (GLV-1h71), HA: ($P_{11k}$)gusA; F14.5L: BamHI-HindIII, TK: ($P_{SEL}$)rTrfR-($P_{7.5k}$)LacZ (GLV-1h73), HA:HindIII-BamHI and F14.5L: BamHI-HindIII, TK:SacI-BamHI (GLV-1h85), HA: ($P_{11k}$) gusA. Strains GLV-1h71, GLV-1h73 and GLV-1h85 were generated by inserting a short non-coding DNA fragment containing Bam HI and HindIII sites (SEQ ID NO: 12; aggatcctgcgaagct) into the F14.5L locus of strains GLV-1h68, GLV-1h70 and GLV-1h72, respectively, thereby deleting the Ruc-GFP fusion gene expression cassette at the F14.5L locus of these strains. Vector pNCVVf14.5lT contains the non-coding DNA fragment flanked by sequences of the F14.5L gene, the *E. coli* guanine phosphoribosyltransferase (gpt) gene under the control of the vaccinia virus $P_{7.5kE}$ promoter for transient dominant selection of virus that has incorporated the vector, and sequences of the pUC plasmid. The left and right flanking sequences of the VV F14.5L gene (see nucleotides 41476 to 41625 of SEQ ID NO: 2) that were incorporated into the vector correspond to nucleotides 41593 to 42125 and nucleotides 41018 to 41592, respectively of SEQ ID NO: 2. The F14.5L gene flanking DNAs were PCR-amplified from VV LIVP using Platinum PCR SuperMix High Fidelity and the following primers containing the non-coding DNA sequence:

```
                                     (SEQ ID NO: 13)
Left Flank:
5'-GCGCATATGTAGAAGAATTGATAAATATG-3'
```

-continued

```
and (SEQ ID NO: 14)
5'-GCCGCAGGATCCTGCGAAGCTTACAGACACGAATATGACTAAACCGA
TG-3', (SEQ ID NO: 15)
Right Flank:
5'-GTCTGTAAGCTTCGCAGGATCCTGCGGCCGCCATCGTCGGTGTGTTG
TC-3'
and (SEQ ID NO: 16)
5'-GCGGAATTCAGAGGATTACAACAAAAAGATG-3'.
```

The two fragments were joined together as described above (gene-splicing by overlapping extension). The resulting fragment was digested with NdeI and EcoRI and cloned into the same-cut vector pUCP7.5-gpt-1 (SEQ ID NO: 10) to generate the construct pNCVVf14.5lT (SEQ ID NO: 11). The flanking sequences of F14.5L in the target vector were confirmed by sequencing and were identical to nucleotides 41593 to 42125 of SEQ ID NO: 2 (left flank) and nucleotides 41018 to 41592 of SEQ ID NO: 2 (right flank).

c. pCR-TKLR-gpt2: For Insertion of Non-Coding Heterologous DNA in the Vaccinia TK Locus The pCR-TKLR-gpt2 vector (SEQ ID NO: 17) was employed to create vaccinia virus strains GLV-1h72 and GLV-1h74 having the following genotypes: F14.5L: ($P_{SEL}$) Ruc-GFP, TK: SacI-BamHI (GLV-1h72), HA: ($P_{11k}$)gusA and F14.5L: BamHI-HindIII, TK: SacI-BamHI (GLV-1h74), HA:HindIII-BamHI. Strain GLV-1h72 was generated by inserting a short non-coding DNA fragment containing SacI and BamHI sites (SEQ ID NO: 18; ggtaccgagctcggatcc) into the TK locus of starting strain GLV-1h68 thereby deleting the LacZ/rTFr expression cassette at the TK locus of GLV-1h68. Strain GLV-1h74 was generated by inserting the short non-coding DNA fragment containing SacI and Bam HI sites into the TK locus of strain GLV-1h73 thereby deleting the LacZ/rTFr expression cassette at the TK locus of GLV-1h73.

Vector pCR-TKLR-gpt2 was generated from vector pCR2.1 (Invitrogen, Carlsbad, Calif., SEQ ID NO: 21) and contains the non-coding DNA fragment flanked by sequences of the TK gene and the *E. coli* guanine phosphoribosyltransferase (gpt) gene under the control of the vaccinia virus $P_{7.5kE}$ promoter for transient dominant selection of virus that has incorporated the vector. The left flank ($TK_L$) of the TK locus in the LIVP genome that was incorporated into the vector corresponds to nucleotides 79726 to 80231 of SEQ ID NO: 2 (TK locus in the LIVP genome is located at nucleotides 78142 to 80961 of SEQ ID NO: 2). The left flank DNA was PCR amplified with the primers $TK_L$-5 (5'-ATAAGCTTTGTTACAGATGGAAGGGTCAAA-3', SEQ ID NO: 19) and $TK_L$-3 (5'-AGGTACCGTTTGCCATACGCTCACAGA-3', SEQ ID NO: 20) using Invitrogen High Fidelity PCR mix. The PCR product was digested with HindIII and KpnI, and inserted into the corresponding sites in vector pCR2.1 (Invitrogen, Carlsbad, Calif., SEQ ID NO: 21), resulting in pCP-TKL1 (SEQ ID NO: 22). The right flanking region ($TK_R$) of the TK locus in the LIVP genome that was incorporated into the vector corresponds to nucleotides 80211 to 80730 of SEQ ID NO: 2. The right flank DNA was PCR amplified with the primers: $TK_R$-5 (5'-TGAGCTCGGATCCTTCTGTGAGCGTATGGCAAA-3', SEQ ID NO: 23) and $TK_R$-3 (5'-TTACTAGTACACTACGGTGGCACCATCT-3', SEQ ID NO: 24). The PCR product was digested with BamHI and SpeI and cloned into the corresponding sites in vector pCR2.1 to yield pCR-TKR4 (SEQ ID NO: 25). The pCR-TKL1 and pCR-TKR4 contained the correct sequences of $TK_L$ and $TK_R$, respectively, as confirmed by sequencing and were identical to nucleotides 79726 to 80231 of SEQ ID NO: 2 (left flank) and nucleotides 80211 to 80730 of SEQ ID NO: 2 (right flank). The insert TK$_L$ was then excised from pCR-TKL1 by restriction digestion with HindIII and BamHI and inserted into the same-cut vector pCR-TKR4 to yield pCR-TKLR1 (SEQ ID NO: 26) thereby joining the left and right flanking sequences with the non-coding DNA between them in a single fragment.

In order to add DNA encoding *Escherichia coli* guanine phosphoribosyltransferase (gpt) linked to the vaccinia virus promoter p7.5k to pCR-TKLR1 for use in transient dominant selection, a DNA fragment containing these elements was amplified with the primers gpt5 (5'-TCCCAGTCACGACGT-TGTAA-3', SEQ ID NO: 27) and gpt3 (5'-TGATTACGC-CAAGCTGATCC-3', SEQ ID NO: 28) from pUCP7.5-gpt-1 and cloned into vector pCR2.1. The sequence of the insert p7.5k-gpt was confirmed and released with EcoRI and cloned into the same-cut vector pCR-TKLR1 to generate the final transfer vector pCR-TKLR-gpt2 (SEQ ID NO: 17).

d. pNCVVhaT-SEL-hk5: For Insertion of an Expression Cassette Encoding Plasminogen Kringle 5 Domain Under the Control of the Vaccinia P$_{SEL}$ Promoter into the Vaccinia HA Locus Vector pNCVVhaT-SEL-hk5 (SEQ ID NO: 41) was employed to develop strain GLV-1h81 having the following genotype: F14.5L: (P$_{SEL}$)Ruc-GFP, TK: (P$_{SEL}$)rTrfT-(P$_{7.5k}$)LacZ, HA: (P$_{SEL}$)hk-5. Strain GLV-1h81 was generated by inserting DNA encoding the human plasminogen kringle 5 domain (SEQ ID NO: 42) operably linked to the vaccinia virus synthetic early/late promoter (P$_{SEL}$) (SEQ ID NO: 29) into the HA locus of starting strain GLV-1h68 thereby deleting the gusA expression cassette at the HA locus of GLV-1h68. Vector pNCVVhaT-SEL-hk5 contains a DNA fragment encoding the human plasminogen kringle 5 domain operably linked to the vaccinia synthetic early/late promoter (P$_{SEL}$), sequences of the HA gene flanking the (P$_{SEL}$)hk-5 DNA fragment, the *E. coli* guanine phosphoribosyltransferase (gpt) gene under the control of the vaccinia virus P$_{7.5k}$E promoter for transient dominant selection of virus that has incorporated the vector, and sequences of the pUC plasmid.

To generate vector pNCVVhaT-SEL-hk5, DNA encoding human plasminogen kringle 5 was PCR-amplified from the plasmid pBLAST-hKringle5 (Invivogen, San Diego, Calif.; SEQ ID NO: 43) using AccuPrime Pfx SuperMix (Invitrogen, Carlsbad, Calif.) and primers: 5'-GCGAAGCTTACCATG-TACAGGATGCAACTCCTGTCTTG-3' (SEQ ID NO: 44) and 5'-GCGGGATCCAGAAAAACTAATCAAAT-GAAGGGGCCGCACACTG-3' (SEQ ID NO: 45). The PCR product was digested with HindIII and BamHI and cloned into the same-cut vector pNCVVhaT-SEL-ADP-V5 (SEQ ID NO: 46); similar to pNCVVhaT, but contains ADP-V5 under the control of the synthetic early/late promoter in between the flanking sequences of HA to replace adenovirus death protein (ADP) gene tagged with V5 at 3' end. The sequence of the human plasminogen kringle 5 domain was confirmed by sequencing.

e. pNCVVhaT-ftn: For Insertion of an Expression Cassette Encoding *E. Coli* Ferritin Under the Control of the Vaccinia P$_{SEL}$ Promoter into the Vaccinia HA Locus Vector pNCVVhaT-ftn (SEQ ID NO: 47) was employed to develop strains GLV-1h82 and GLV-1h83 having the following genotypes: F14.5L: (P$_{SEL}$)Ruc-GFP, TK: (P$_{SEL}$)TrfR-(P$_{7.5k}$)LacZ (strain GLV-1h82), HA: (P$_{SEL}$)ftn, and F14.5L: (P$_{SEL}$)Ruc-GFP, TK: (P$_{SEL}$)rTrfR-(P$_{7.5k}$)LacZ (strain GLV-1h83), HA: (P$_{SEL}$)ftn. Strains GLV-1h82 and GLV-1h83 were generated by inserting DNA encoding *E. coli* ferritin (ftn) (SEQ ID NO: 48) operably linked to the vaccinia virus synthetic early/late promoter (P$_{SEL}$) (SEQ ID NO: 29) into the HA locus of starting strains GLV-1h22 and GLV-1h68, respectively, thereby deleting the gusA expression cassette at the HA locus of these starting strains. Vector pNCVVhaT-ftn contains a DNA fragment encoding *E. coli* ferritin operably linked to the vaccinia synthetic early/late promoter(P$_{SEL}$), sequences of the HA gene flanking the (P$_{SEL}$)ftn DNA fragment, the *E. coli* guanine phosphoribosyltransferase (gpt) gene under the control of the vaccinia virus P$_{7.5kE}$ promoter for transient dominant selection of virus that has incorporated the vector, and sequences of the pUC plasmid.

To generate vector pNCVVhaT-ftn, DNA encoding *E. coli* ferritin (ftn) was amplified from genomic DNA of *E. coli* Top10 (Invitrogen, Carlsbad, Calif.) using the following primers:

```
                                                (SEQ ID NO: 49)
5'SSEL-ftn-VV3
(5'-AAAGATAAGCTTAAAAATTGAAATTTTATTTTTTTTTTTGGAATA
TAAATACCATGCTGAAACCAGAAATGATTGAA-3')
and
                                                (SEQ ID NO: 50)
3'ftn-VV2
(5'-ATAATAGGATCCTTAGTTTTGTGTGTCGAGGGT-3').
```

Primer 5'SSEL-ftn-VV3 introduces a HindIII site, the P$_{SEL}$ promoter sequence for vaccinia virus synthetic strong early/late expression, and a Kozak sequence (ACC) in front of the start codon offtn. 3'ftn-VV2 introduces a BamHI restriction site. The PCR product as well as the plasmid pNCVVhaT (SEQ ID NO: 4) were digested with BamHI and HindIII, ligated, and transformed into *E. coli* Top10 to yield pNCV-VhaT-ftn (SEQ ID NO: 47). This final cloning step places the (P$_{SEL}$)ftn expression cassette between the left and right HA gene flanking sequences in pNCVVhaT and eliminates the non-coding DNA that is located between these flanking sequences in pNCVVhaT.

f. pCR-TK-SEL-mRFP1: For Insertion of an Expression Cassette Encoding a Fusion Protein of CBG99 and mRFP1 Under the Control of the Vaccinia P$_{SEL}$ Promoter into the Vaccinia TK Locus Vector pCR-TK-SEL-mRFP1 (SEQ ID NO: 51) was employed to develop strain GLV-1h84 having the following genotype: F14.5L: BamHI-HindIII, TK: (P$_{SEL}$)CBG99-mRFP1, HA: HindIII-BamHI. Strain GLV-1h84 was generated by inserting DNA encoding a fusion protein of CBG99 (green-emitting click beetle luciferase) and mRFP1 (red fluorescent protein) linked through a picornavirus 2A element (SEQ ID NO: 52) operably linked to the vaccinia virus synthetic early/late promoter (P$_{SEL}$) (SEQ ID NO: 29) into the TK locus of strain GLV-1h73 thereby deleting the rTrfR-LacZ expression cassette at the TK locus of strain GLV-1h73. Vector pCR-TK-SEL-mRFP1 contains a DNA fragment encoding a CBG99-mRFP1 fusion protein operably linked to the vaccinia synthetic early/late promoter (P$_{SEL}$), sequences of the TK gene flanking the (P$_{SEL}$)-fusion protein-encoding DNA fragment, the *E. coli* guanine phosphoribosyltransferase (gpt) gene under the control of the vaccinia virus P7.5k early and late promoter for transient dominant selection of virus that has incorporated the vector, and sequences of the pUC plasmid.

To generate vector pCR-TK-SEL-mRFP1, cDNA encoding the fusion protein CBG99 (green-emitting click beetle luciferase) and mRFP1 (red fluorescent protein) linked through the picornavirus 2A element was PCR amplified from CBG99-2A-mRFP1 (SEQ ID NO: 53) with the primers:

mRFP5 (5'-GTCGACGCCACCATGGTGAAGCGTGAG-3') (SEQ ID NO: 54)
and mRFP3 (5'-TCATTAGGCGCCGGTGGAGT-3'). (SEQ ID NO: 55)

The PCR product was cloned into vector pCR-Blunt 1'-TOPO (Invitrogen; SEQ ID NO: 40) to yield pCRII-mRFP (SEQ ID NO: 56). After confirming the sequence, the CBG99-mRFP1 fusion cDNA molecule (SEQ ID NO: 52) was released by SalI and EcoRV restriction enzyme digest and inserted into pCR-SEL4 (SEQ ID NO: 33), precut with SalI and SmaI to generate plasmid pCR-SEL-mRFP1 (SEQ ID NO: 57). (pCR-SEL4 was constructed as follows: The cDNA spanning the synthetic early/late promoter $P_{SEL}$ (SEQ ID NO: 29) for vaccinia virus and the multiple cloning site (MCS) region in pSC65 (SEQ ID NO: 30) was PCR amplified with the primers SEL5 (5'-TAGAGCTCGGTTTGGAATTAGTGAAAGC-3') (SEQ ID NO: 31) and SEL3 (5'-TAGAGCTCTCCAGACATTGTTGAATTAG-3') (SEQ ID NO: 32), and cloned into the TA cloning site of vector pCR2.1 to yield pCR-SEL4 (SEQ ID NO: 33)). This intermediate cloning step placed the fusion cDNA molecule under the control of vaccinia virus synthetic early/late promoter ($P_{SEL}$). The SEL-CBG99-mRFP1 expression cassette was then released by SacI digestion and cloned into the same-cut vaccinia virus TK locus transfer vector pCR-TKLR-gpt2 (SEQ ID NO: 17) to give the final construct pCR-TK-SEL-mRFP1 (SEQ ID NO: 51). This final cloning step placed the ($P_{SEL}$) CBG99-mRFP1 expression cassette between the left and right TK gene flanking sequences in pCR-TKLR-gpt2 and eliminated the non-coding DNA that is located between these flanking sequences in pCR-TKLR-gpt2.

g. pCR-gpt-dA35R6: For Deletion of the A35R Locus and Insertion of a Non-Coding Heterologous DNA with Multiple Cloning Sites Vector pCR-gpt-dA35R-6 (SEQ ID NO: 89) was employed to create vaccinia strains GLV-1j87, GLV-1j88 and GLV-1j89, having the following genotypes: F14.5L: ($P_{SEL}$)Ruc-GFP, TK: ($P_{SEL}$)rTrfR-($P_{7.5k}$)LacZ, HA: ($P_{11k}$)gusA, A35R: deleted, multiple cloning sites (MCS) (strain GLV-1j87); F14.5L: BamHI-HindIII, TK: ($P_{SEL}$)rTrfR-($P_{7.5k}$)LacZ, HA: HindIII-BamH1, A35R: deleted, MCS (strain GLV-1j88); and F14.5L: BamHI-HindIII, TK: SacI-BamHI, HA: HindIII-BamH1, A35R: deleted, MCS (strain GLV-1j89). Strains GLV-1j87, GLV-1j88 and GLV-1j89, were generated by inserting a short DNA fragment with multiple cloning sites (HindIII, SacI and BamHI) into the A35R locus of strains GLV-1h68, GLV-1h73 and GLV-1h74, respectively, thereby creating a fusion of the flanking A34R and A36R regions and deleting the A35R gene. Vector pCR-gpt-dA35R-6 contains a non-coding DNA fragment with multiple cloning sites flanked by sequences that flank the A35R gene (a fusion of A34R and A36R regions) and the E. coli guanine phosphoribosyltransferase (gpt) gene under the control of the vaccinia virus $P_{7.5k}$ promoter for transient dominant selection of virus that has incorporated the vector.

The left and right flanking sequences of A35R, the A34R and A36R regions, were PCR amplified. The A34R gene region was PCR amplified with primers A34R-L: 5'-ATCTCGAGTGAGGATACATGGGGATCTGATG-3' (SEQ ID NO: 66) and A34R-R: 5'-ATGAGCTCCCGGGAAGCTTGGCGGCGTACGTTAACGAC-3' (SEQ ID NO: 67), using LIVP genomic DNA (SEQ ID NO: 2) as the template.

The A36R gene region was PCR amplified with primers

A36R-L: 5'-ATGAGCTCGGATCCTGCATATCAGACGGCAATGG-3' (SEQ ID NO: 68) and

A36R-R: 5'-ATGGGCCCATCGCTATGTGCTCGTCTA-3' (SEQ ID NO: 69), using LIVP genomic DNA (SEQ ID NO: 2) as the template.

The A34R and A36R PCR products were digested with SacI, and the restricted products were then purified and ligated together. The A34R and A36R ligation product was used as the template for PCR amplification of the A34R and A36R fusion cDNA, with primers A34R-L and A36R-R. The amplified fusion cDNA was cloned into pCR-Blunt II-TOPO vector (Invitrogen; SEQ ID NO: 40) to generate vector pCRII-dA35R-1 (SEQ ID NO: 87). The resulting vector was confirmed by sequencing.

A p7.5-gpt expression vector with the HindIII, SacI and BamHI sites removed was then generated. The TK region in the TK locus transfer vector pCR-TKLR-gpt2 (SEQ ID NO: 17) was removed with HindIII and SpeI digestion. The vector fragment was blunt ended with Klenow treatment, and then ligated to generate construct pCR-dTK-gpt1 (SEQ ID NO: 88). The restriction sites HindIII, SacI and BamHI are removed in the resulting pCR-dTK-gpt1 vector (SEQ ID NO: 88).

To generate pCR-gpt-dA35R-6, the A34R and A36R fusion cDNA was released from pCRII-dA35R-1 (SEQ ID NO: 87) by XhoI and ApaI digestion, and inserted into vector pCR-dTK-gpt1 (SEQ ID NO: 88), precut with XhoI and ApaI. The resulting construct pCR-gpt-dA35R-6 (SEQ ID NO: 89) was confirmed by sequencing.

h. HA-SE-IL-6-1: For Insertion of an Expression Cassette Encoding sIL-6R/IL-6 Under the Control of the Vaccinia $P_{SE}$ Promoter into the Vaccinia HA Locus.

Vector HA-SE-IL-6-1 (SEQ ID NO: 77) was employed to develop strain GLV-1h90 having the following genotype: F14.5L: ($P_{SEL}$)Ruc-GFP, TK: ($P_{SEL}$)rTrfR-($P_{7.5}$k)LacZ, HA: ($P_{SE}$)SIL-6R/IL-6. Strain GLV-1h90 was generated by inserting DNA encoding a fusion protein of human IL-6 (encoding amino acids 29~212) fused to the human soluble IL-6 receptor (sIL-6R) (amino acids 1~323) by a linker sequence (encoding RGGGGSGGGGSVE (SEQ ID NO: 90); complete sequence of sIL-6R/IL insert (SEQ ID NO: 106)) operably linked to the vaccinia virus synthetic early promoter ($P_{SE}$) (SEQ ID NO: 35) into the HA locus of strain GLV-1h68, thereby deleting the gusA expression cassette at the HA locus of starting GLV-1h68. Vector HA-SE-IL-6-1 contains a DNA fragment encoding the sIL-6R/IL-6 fusion protein operably linked to the vaccinia synthetic early promoter ($P_{SE}$) and sequences of the HA gene flanking the (PsE)-fusion protein-encoding DNA fragment.

Plasmid pCR-SE1 (SEQ ID NO: 36), containing the vaccinia synthetic early promoter, i.e., $P_{SE}$, was used as the source of the vaccinia synthetic early promoter in generating vector HA-SE-IL-6-1. pCR-SE1 was constructed as follows. The multiple cloning site (MCS) region in pSC65 (Moss and Earl, Current Protocols in Molecular Biology, 16.17.4, 1998; SEQ ID NO: 30) was PCR amplified with the primers:

SE5: 5'-TAGAGCTCAAAAATTGAAAAACTAGCGTCTTTTTTTGCTCGAAGTCGAC AGATCTAGGCCTG-3' (SEQ ID NO: 34), containing the sequence for synthetic early promoter $P_{SE}$ (SEQ ID NO: 35), and

SEL3:

(SEQ ID NO: 32)
5'-TAGAGCTCTCCAGACATTGTTGAATTAG-3'.

The resulting PCR product was inserted into the TA cloning site of vector pCR2.1 to obtain pCR-SE1 (SEQ ID NO: 36).

To generate vector HA-SE-IL-6-1, cDNA encoding the fusion protein sIL-6R/IL-6 was PCR amplified from pCDM8-H-IL-6 (U.S. Pat. No. 7,112,436) with the primers:

(SEQ ID NO: 62)
5'-<u>GTCGAC</u>CCACCATGCTGGCCGTCGGCTGCGC-3'
and (SEQ ID NO: 63)
5'-<u>GGTACC</u>CTAGAGTCGCGGCCGCGACC-3'.

The PCR product was cloned into vector pCR-BluntII-TOPO (Invitrogen; SEQ ID NO: 40) to yield pCRII-IL6-3 (SEQ ID NO: 73). After confirming the sequence, the sIL-6R/IL-6 fusion cDNA molecule (SEQ ID NO: 106) was released by KpnI (blunt ended) and SalI restriction enzyme digest and inserted into vector pCR-SE1 (SEQ ID NO: 36), precut with SalI and SmaI to generate plasmid pCR-SE-IL6-7 (SEQ ID NO: 74), thus placing the IL-6 fusion cDNA under the control of vaccinia virus synthetic early (SE) promoter.

The cDNA of SE-IL6 was released from pCR-SE-IL6-7 (SEQ ID NO: 74) by HindIII and BamHI restriction enzyme digest and inserted into the HA transfer vector, pNCVVhaT (SEQ ID NO: 4), precut with HindIII and BamHI to generate plasmid HA-SE-IL6-1 (SEQ ID NO: 77). The SL-sIL-6R/IL-6 fusion expression was confirmed by sequencing.

i. HA-SEL-IL-6-1: For Insertion of an Expression Cassette Encoding sIL-6R/IL-6 Under the Control of the Vaccinia $P_{SEL}$ Promoter into the Vaccinia HA Locus.

Vector HA-SEL-IL-6-1 (SEQ ID NO: 79) was employed to develop strain GLV-1h91 having the following genotype: F14.5L: ($P_{SEL}$)Ruc-GFP, TK: ($P_{SEL}$)rTrfR-($P_{7.5k}$)LacZ HA: ($P_{SEL}$)SIL-6R/IL-6. Strain GLV-1h91 was generated by inserting DNA encoding the sIL-6R/IL-6 fusion protein operably linked to the vaccinia virus synthetic early/late promoter ($P_{SEL}$) (SEQ ID NO: 29) into the HA locus of starting strain GLV-1h68, thereby deleting the gusA expression cassette at the HA locus of starting GLV-1h68. Vector HA-SEL-IL-6-1 contains a DNA fragment encoding the sIL-6R/IL-6 fusion protein operably linked to the vaccinia synthetic early promoter ($P_{SEL}$) and sequences of the HA gene flanking the ($P_{SEL}$)-fusion protein-encoding DNA fragment.

Plasmid pCR-SEL4 (SEQ ID NO: 33; see (f) above for construction of pCR-SEL4), containing the vaccinia synthetic early/late promoter, i.e., $P_{SEL}$, was used as the source of the vaccinia synthetic early/late in generating vector HA-SEL-IL-6-1.

To generate vector HA-SL-IL-6-1, the sIL-6R/IL-6 fusion cDNA molecule (SEQ ID NO: 106) was released from vector pCRII-IL6-3 (see (h) above; SEQ ID NO: 73) by KpnI and SalI restriction enzyme digest and inserted into vector pCR-SEL4 (SEQ ID NO: 33), precut with SalI and SmaI to generate plasmid pCR-SEL-IL6-2 (SEQ ID NO: 76), thus placing the IL-6 fusion cDNA under the control of vaccinia virus synthetic early/late ($P_{SEL}$) promoter.

The cDNA of SEL-IL6 was released from pCR-SEL-IL6-2 (SEQ ID NO: 76) by HindIII restriction enzyme digest and inserted into the HA transfer vector, pNCVVhaT (SEQ ID NO: 4), precut with HindIII to generate plasmid HA-SEL-IL6-1 (SEQ ID NO: 79). The SEL-sIL-6R/IL-6 fusion expression cassette was confirmed by sequencing.

j. HA-SL-IL-6-1: For Insertion of an Expression Cassette encoding sIL-6R/IL-6 Under the Control of the Vaccinia $P_{SL}$ Promoter into the Vaccinia HA Locus.

Vector HA-SL-IL-6-1 (SEQ ID NO: 78) was employed to develop strain GLV-1h92 having the following genotype: F14.5L: ($P_{SEL}$)Ruc-GFP, TK: ($P_{SEL}$)rTrfR-($P_{7.5}$k)LacZ, HA: ($P_{SL}$)sIL-6R/IL-6. Strain GLV-1h92 was generated by inserting DNA encoding the sIL-6R/IL-6 fusion protein (SEQ ID NO: 106) operably linked to the vaccinia virus synthetic late promoter ($P_{SL}$) (SEQ ID NO: 38) into the HA locus of starting strain GLV-1h68, thereby deleting the gusA expression cassette at the HA locus of starting GLV-1h68. Vector HA-SL-IL-6-1 contains a DNA fragment encoding the sIL-6R/IL-6 fusion protein operably linked to the vaccinia synthetic late promoter ($P_{SL}$) and sequences of the HA gene flanking the (PsL)-fusion protein-encoding DNA fragment.

Plasmid pCR-SL3 (SEQ ID NO: 39), containing the vaccinia synthetic late promoter, i.e., $P_{SL}$, was used as the source of the vaccinia synthetic late promoter in generating vector HA-SL-IL-6-1 (SEQ ID NO: 78). To construct pCR-SL3, the MCS region in pSC65 was PCR amplified with the primers:

SL5:
5'-TAGAGCTCTTTTTTTTTTTTTTTTTTTTTGGCATA
TAAATAAGTCGA CAGATCTAGGCCTG-3' (SEQ ID NO: 37), containing the sequence for synthetic late promoter $P_{SL}$ (SEQ ID NO: 38), and SEL3:
5'-TAGAGCTCTCCAGACATTGTTGAATTAG-3')
(SEQ ID NO: 32). The resulting PCR product was cloned into the TA cloning site of vector pCR2.1 to yield pCR-SL3 (SEQ ID NO: 39).

To generate vector HA-SL-IL-6-1, the sIL-6R/IL-6 fusion cDNA molecule (SEQ ID NO: 106) was released from vector pCRII-IL6-3 (see (h) above; SEQ ID NO: 73) by KpnI and SalI restriction enzyme digest and inserted into vector pCR-SL3 (SEQ ID NO: 39), precut with SalI and SmaI to generate plasmid pCR-SL-IL6-2 (SEQ ID NO: 75), thus placing the IL-6 fusion cDNA under the control of vaccinia virus synthetic late (SL) promoter.

The cDNA of SL-sIL-6R/IL-6 was released from pCR-SL-IL6-2 (SEQ ID NO: 75) by HindIII and BamHI restriction enzyme digest and inserted into the HA transfer vector, pNCVVhaT (SEQ ID NO: 4), precut with HindIII and BamHI to generate plasmid HA-SL-IL6-1 (SEQ ID NO: 78). The SL-sIL-6R/IL-6 fusion expression cassette was confirmed by sequencing.

k. FSE-IL-24: For Insertion of an Expression Cassette Encoding IL-24 Under the Control of the Vaccinia $P_{SE}$ Promoter into the Vaccinia F14.5L Locus.

Vector FSE-IL-24 (SEQ ID NO: 84) was employed to develop strain GLV-1h96 having the following genotype: F14.5L: ($P_{SE}$)IL-24, TK: ($P_{SEL}$)rTrfR-($P_{7.5k}$)LacZ HA: ($P_{11k}$) gusA. Strain GLV-1h96 was generated by inserting DNA encoding human IL-24 operably linked to the vaccinia virus synthetic early promoter ($P_{SE}$) (SEQ ID NO: 35) into the F14.5L locus of strain GLV-1h68, thereby deleting the Ruc-GFP fusion gene expression cassette at the F14.5L locus of GLV-1h68. Vector FSE-IL-24 contains a DNA fragment encoding the IL-24 protein operably linked to the vaccinia synthetic early promoter ($P_{SE}$) and sequences of the F14.5L gene flanking the ($P_{SE}$)-fusion protein-encoding DNA fragment.

Plasmid pCR-SE1 (SEQ ID NO: 36; see (h) above for description of pCR-SE1), containing the vaccinia synthetic early promoter, i.e., $P_{SE}$, was used as the source of the vaccinia synthetic early promoter in generating vector FSE-IL-24.

To generate vector FSE-IL-24, cDNA encoding the human IL-24 was PCR amplified from cDNA clone MGC:8926 (complete cds from Origene Trueclone collection) with the primers:

```
                                      (SEQ ID NO: 64)
5'- GTCGACCACCATGAATTTTCAACAGAGGCTGC-3'
and (SEQ ID NO: 65)
5'- CCCGGGTTATCAGAGCTTGTAGAATTTCTGCATC-3'.
```

The PCR product was cloned into vector pCR-Blunt 1'-TOPO (Invitrogen; SEQ ID NO: 40) to yield pCRII-IL24-3 (SEQ ID NO: 80). After confirming the sequence, the IL-24 cDNA molecule (SEQ ID NO: 107) was released by SalI and SmaI digestion and inserted into vector pCR-SE1 (SEQ ID NO: 36), precut with SalI and SmaI to generate plasmid pCR-SE-IL24-2 (SEQ ID NO: 81), thus placing the IL-24 cDNA under the control of vaccinia virus synthetic early (SE) promoter.

The cDNA of SE-IL24 was released from pCR-SE-IL24-2 (SEQ ID NO: 81) by HindIII and BamHI restriction enzyme digest and inserted into the F14.5L transfer vector, pNCVVf14.5lT (SEQ ID NO: 11), precut with HindIII and BamHI to generate plasmid FSE-IL24-1 (SEQ ID NO: 84). The SL-IL-24 expression was confirmed by sequencing.

l. FSEL-IL-24: For Insertion of an Expression Cassette Encoding IL-24 Under the Control of the Vaccinia $P_{SEL}$ Promoter into the Vaccinia F14.5L Locus.

Vector FSEL-IL24-1 (SEQ ID NO: 86) was employed to develop strain GLV-1h97 having the following genotype: F14.5L: ($P_{SEL}$)IL-24, TK: ($P_{SEL}$)rTrfR-($P_{7.5}$k)LacZ, HA: ($P_{11k}$)gusA. Strain GLV-1h97 was generated by inserting DNA human IL-24 operably linked to the vaccinia virus synthetic early/late promoter ($P_{SEL}$) (SEQ ID NO: 29) into the F14.5L locus of strain GLV-1h68, thereby deleting the Ruc-GFP fusion gene expression cassette at the F14.5L locus of GLV-1h68. Vector FSEL-IL24-1 contains a DNA fragment encoding the IL-24 protein operably linked to the vaccinia synthetic early/late promoter ($P_{SEL}$), sequences of the F14.5L gene flanking the ($P_{SEL}$)-fusion protein-encoding DNA fragment, the *E. coli* guanine phosphoribosyltransferase (gpt) gene under the control of the vaccinia virus $P_{7.5k}$ early and late promoter for transient dominant selection of virus that has incorporated the vector, and sequences of the pUC plasmid.

Plasmid pCR-SEL4 (SEQ ID NO: 33; see (f) above for construction of pCR-SEL4), containing the vaccinia synthetic early/late promoter, i.e., $P_{SEL}$, was used as the source of the vaccinia synthetic early/late in generating vector FSEL-IL24-1.

To generate vector FSEL-IL24-1, the IL-24 cDNA molecule (SEQ ID NO: 107) was released from vector pCRII-IL24-3 (see (k) above; SEQ ID NO: 80) by KpnI and SalI restriction enzyme digest and inserted into vector pCR-SEL4 (SEQ ID NO: 33), precut with SalI and SmaI to generate plasmid pCR-SEL-IL24-2 (SEQ ID NO: 83), thus placing the IL-6 fusion cDNA under the control of vaccinia virus synthetic early/late ($P_{SEL}$) promoter.

The cDNA of SEL-IL24 was released from pCR-SEL-IL24-2 (SEQ ID NO: 83) by HindIII restriction enzyme digest and inserted into the F14.5L transfer vector, pNCVVf14.5lT (SEQ ID NO: 11), precut with HindIII to generate plasmid FSEL-IL24-1 (SEQ ID NO: 86). The SEL-IL-24 expression cassette was confirmed by sequencing.

m. FSL-IL-24: For Insertion of an Expression Cassette Encoding IL-24 Under the Control of the Vaccinia $P_{SL}$ Promoter into the vaccinia F14.5L Locus.

Vector FSL-IL24-1 (SEQ ID NO: 85) was employed to develop strain GLV-1h98 having the following genotype: F14.5L: ($P_{SL}$)IL-24, TK: ($P_{SEL}$)rTrfR-($P_{7.5k}$)LacZ, HA: ($P_{11k}$)gusA. Strain GLV-1h98 was generated by inserting DNA encoding the human IL-24 protein operably linked to the vaccinia virus synthetic late promoter ($P_{SL}$) (SEQ ID NO: 38) into the F14.5L locus of starting strain GLV-1h68, thereby deleting the Ruc-GFP fusion gene expression cassette at the F14.5L locus of GLV-1h68. Vector FSL-IL24-1 contains a DNA fragment encoding the IL-24 protein operably linked to the vaccinia synthetic late promoter ($P_{SL}$) and sequences of the F14.5L gene flanking the ($P_{SL}$)-fusion protein-encoding DNA fragment.

Plasmid pCR-SL3 (SEQ ID NO: 39; see (j) above for description of pCR-SL3), containing the vaccinia synthetic late promoter, i.e., $P_{SL}$, was used as the source of the vaccinia synthetic late promoter in generating vector FSL-IL24-1.

To generate vector FSL-IL24-1, the IL-24 cDNA molecule (SEQ ID NO: 107) was released from vector pCRII-IL24-3 (see (k) above; SEQ ID NO: 80) by KpnI and SalI restriction enzyme digest and inserted into vector pCR-SL3 (SEQ ID NO: 39), precut with SalI and SmaI to generate plasmid pCR-SL-IL24-2 (SEQ ID NO: 82), thus placing the IL-24 fusion cDNA under the control of vaccinia virus synthetic late (SL) promoter.

The cDNA of SL-IL-24 was released from pCR-SL-IL24-2 (SEQ ID NO: 82) by HindIII and BamHI restriction enzyme digest and inserted into the F14.5L transfer vector, pNCVVf14.5lT (SEQ ID NO: 11), precut with HindIII and BamHI to generate plasmid FSL-IL24-1 (SEQ ID NO: 85). The SL-IL-24 expression cassette was confirmed by sequencing.

n. pCR-TK-SE-tTF-RGD: For Insertion of an Expression Cassette Encoding the tTF-Rgd Fusion Protein Under the Control of the Vaccinia $P_{SE}$ Promoter into the Vaccinia TK Locus Vector pCR-TK-SE-tTF-RGD (SEQ ID NO: 95) was employed to develop strain GLV-1h104 having the following genotype: F14.5L: ($P_{SEL}$)Ruc-GFP; TK: ($P_{SE}$) tTF-RGD; HA: ($P_{11k}$)gusA. Strain GLV-1h104 was generated by inserting DNA encoding a tTF-RGD fusion protein (SEQ ID NO: 92 (DNA sequence); SEQ ID NO: 93 (amino acid sequence)) into the TK locus of strain GLV-1h68 thereby deleting the rTrfR-LacZ expression cassette at the TK locus of strain GLV-1h68. Vector pCR-TK-SE-tTF-RGD contains a DNA fragment encoding the tTF-RGD fusion protein operably linked to the vaccinia synthetic early promoter ($P_{SE}$), sequences of the TK gene flanking the ($P_{SE}$)-fusion protein-encoding DNA fragment, the *E. coli* guanine phosphoribosyltransferase (gpt) gene under the control of the vaccinia virus $P_{7.5k}$ early and late promoter for transient dominant selection of virus that has incorporated the vector, and sequences of the pUC plasmid.

cDNA encoding human tissue factor (huTF) was synthesized from RNA extracted from MCF-7 cells (Qiagen RNA extraction kit). The huTF cDNA was synthesized from the RNA in a reverse transcriptase reaction (Invitrogen Superscript II cDNA synthesis kit) using primer hu-tTF-RGD-rev-cDNA, which binds to a region upstream of the huTF sequence:

hu-tTF-RGD-rev-cDNA
5'-CTTTCTACACTTGTGTAGAGATATAGC-3' (SEQ ID NO: 91)

After cDNA synthesis, the tTF-RGD fragment was PCR amplified (Invitrogen Accu Prime Pfx Supermix) using hu-TF cDNA as a template and the following primers:
hu-tTF-RGD-for (SalI)
5'-GTCGACCCACCATGGAGACCCCTGCCTG-3' (SEQ ID NO: 115) and
hu-tTF-RGD-rev (PacI)
5'-TTAATTAATATTATGGAGAATCACCTCT-TCCTCTGAATTCCCCTT TCTCCTGG-3' (SEQ ID NO: 116). The hu-tTF-RGD-rev primer contains additional restriction endonuclease sites and the sequence of the RGD binding motif.

The PCR product was cloned into vector pCR-Blunt 1'-TOPO (Invitrogen; SEQ ID NO: 40) via blunt end ligation (Quick Ligation Kit; New England Biolabs) to yield pCRII-tTF-RGD (SEQ ID NO: 94). The tTF-RGD cDNA molecule (SEQ ID NO: 92) was confirmed by sequencing.

The vaccinia synthetic early promoter, i.e., $P_{SE}$, and flanking TK gene regions of pCR-TK-SE-tTF-RGD are derived from an intermediate plasmid, TK-SE-CSF-2 (SEQ ID NO: 110), which contains the cDNA for GM-CSF under the control of the vaccinia synthetic early promoter flanked by the TK gene regions. pCR-SE1 (SEQ ID NO: 36; see (h) above for description of pCR-SE1), containing the vaccinia synthetic early promoter, i.e., $P_{SE}$, was used as the source of the vaccinia synthetic early promoter in generating vector TK-SE-CSF-2. The cDNA encoding GM-CSF protein (mouse granulocyte-macrophage colony-stimulating factor) was PCR amplified from pPICZA-mGM-CSF (SEQ ID NO: 72) with the primers GM-CSF5 5'-CTAGTCGACATGTGGCTGCA-GAATTTACTTTTCCTGGGCATTGTGGTCT ACAGC-CTCTCAGCACCCACCCGCTCACCCATC-3' (SEQ ID NO: 70), containing the signal peptide sequence, and
GM-CSF3
5'-GGGTCATTTTTGGACTGGTTTTT-3' (SEQ ID NO: 71), containing a stop codon. The PCR amplification product was cloned into vector pCR-Blunt II-TOPO (SEQ ID NO: 40; Invitrogen, Carlsbad, Calif.). The resulting vector pCRII-CSF9 (SEQ ID NO: 108), which contained the correct insert, was digested with SalI and EcoRI (blunt-ended after digestion), and the released GM-CSF cDNA was cloned into vector pCR-SE1 (SEQ ID NO: 36) precut with SalI and SmaI, resulting in SE-CSF-2 (SEQ ID NO: 109). Thus, SE-CSF-2 contains the vaccinia synthetic early promoter ($P_{SE}$) operably linked to DNA encoding GM-CSF. The GM-CSF expression cassette containing GM-CSF cDNA under the control of the $P_{SE}$ was excised from SE-CSF-2 by SacI digestion and cloned into the same-cut vector pCR-TKLR-gpt2 (SEQ ID NO: 17) to generate the construct TK-SE-CSF-2 (SEQ ID NO: 110). This cloning step places the ($P_{SE}$)GM-CSF expression cassette between the left and right TK gene flanking sequences in pCR-TKLR-gpt2 and eliminates the non-coding DNA that is located between these flanking sequences in pCR-TKLR-gpt2.

To generate vector pCR-TK-SE-tTF-RGD, the tTF-RGD fragment was released by SalI and PacI restriction enzyme digest of pCRII-tTF-RGD (SEQ ID NO: 94) and inserted into TK-SE-CSF-2 (SEQ ID NO: 110), precut with SalI and PacI, to generate plasmid pCR-TK-SE-tTF-RGD (SEQ ID NO: 95), thus placing the tTF-RGD cDNA under the control of vaccinia virus synthetic early ($P_{SE}$) promoter and in between the left and right TK gene flanking sequences. The tTF-RGD cDNA insert was confirmed by sequencing.

o. pCR-TK-SEL-tTF-RGD: For Insertion of an Expression Cassette Encoding the tTF-RGD Fusion Protein Under the Control of the Vaccinia $P_{SEL}$ Promoter into the Vaccinia TK Locus Vector pCR-TK-SEL-tTF-RGD (SEQ ID NO: 96) was employed to develop strain GLV-1h105 having the following genotype: F14.5L: ($P_{SEL}$)Ruc-GFP; TK: ($P_{SEL}$) tTF-RGD; HA: ($P_{11k}$)gusA. Strain GLV-1h105 was generated by inserting DNA encoding a tTF-RGD fusion protein (SEQ ID NO: 92) into the TK locus of strain GLV-1h68 thereby deleting the rTrfR-LacZ expression cassette at the TK locus of strain GLV-1h68. Vector pCR-TK-SEL-tTF-RGD contains a DNA fragment encoding the tTF-RGD fusion protein operably linked to the vaccinia synthetic early/late promoter ($P_{SEL}$), sequences of the TK gene flanking the ($P_{SEL}$)-fusion protein-encoding DNA fragment, the E. coli guanine phosphoribosyltransferase (gpt) gene under the control of the vaccinia virus $P_{7.5k}$ early and late promoter for transient dominant selection of virus that has incorporated the vector and sequences of the pUC plasmid.

The vaccinia synthetic early/late promoter, i.e., $P_{SEL}$, and flanking TK gene regions of pCR-TK-SEL-tTF-RGD are derived from an intermediate plasmid, TK-SEL-CSF-2 (SEQ ID NO: 112), which contains the cDNA for GM-CSF under the control of the vaccinia synthetic early/late promoter flanked by the TK gene regions. Plasmid pCR-SEL4 (SEQ ID NO: 33; see (f) above for construction of pCR-SEL4), containing the vaccinia synthetic early/late promoter, i.e., $P_{SEL}$, was used as the source of the vaccinia synthetic early/late in generating vector TK-SEL-CSF-2. DNA encoding GM-CSF was excised from pCRII-CSF9 (SEQ ID NO: 108) with SalI and EcoRI (blunt-ended after digestion), and cloned into vector pCR-SEL4 (SEQ ID NO: 33) precut with SalI and SmaI, resulting in SEL-CSF-2 (SEQ ID NO: 111). Thus, SEL-CSF-2 contains the vaccinia synthetic early/late promoter ($P_{SEL}$) operably linked to DNA encoding GM-CSF. The GM-CSF expression cassette containing DNA encoding GM-CSF under the control of $P_{SEL}$ was then excised from SEL-CSF-2 by SacI digestion and cloned into the same-cut vector pCR-TKLR-gpt2 (SEQ ID NO: 17) to generate the construct TK-SEL-CSF-2 (SEQ ID NO: 112). This cloning step places the ($P_{SEL}$)GM-CSF expression cassette between the left and right TK gene flanking sequences in pCR-TKLR-gpt2 and eliminates the non-coding DNA that is located between these flanking sequences in pCR-TKLR-gpt2.

To generate vector pCR-TK-SEL-tTF-RGD, the tTF-RGD fragment was released by SalI and PacI restriction enzyme digest of pCRII-tTF-RGD (see (n) above; SEQ ID NO: 94) and inserted into TK-SEL-CSF-2 (SEQ ID NO: 112), precut with SalI and PacI to generate plasmid pCR-TK-SEL-tTF-RGD (SEQ ID NO: 96), thus placing the tTF-RGD cDNA under the control of vaccinia virus synthetic early/late ($P_{SEL}$) promoter and in between the left and right TK gene flanking sequences. The tTF-RGD cDNA insert was confirmed by sequencing.

p. pCR-TK-SL-tTF-RGD: For Insertion of an Expression Cassette Encoding the tTF-RGD Fusion Protein Under the Control of the Vaccinia $P_{SL}$ Promoter into the Vaccinia TK Locus Vector pCR-TK-SL-tTF-RGD (SEQ ID NO: 97) was employed to develop strain GLV-1h106 having the following genotype: F14.5L: ($P_{SEL}$)Ruc-GFP; TK: ($P_{SL}$) tTF-RGD; HA: ($P_{11k}$)gusA. Strain GLV-1h106 was generated by inserting DNA encoding a tTF-RGD fusion protein (SEQ ID NO: 92) into the TK locus of strain GLV-1h68 thereby deleting the rTrfR-LacZ expression cassette at the TK locus of strain GLV-1h68. Vector pCR-TK-SL-tTF-RGD contains a DNA fragment encoding the tTF-RGD fusion protein operably linked to the vaccinia synthetic late promoter (PsL), sequences of the TK gene flanking the (PsL)-fusion protein-encoding DNA fragment, the *E. coli* guanine phosphoribosyltransferase (gpt) gene under the control of the vaccinia virus P7.5k early and late promoter for transient dominant selection of virus that has incorporated the vector, and sequences of the pUC plasmid.

The vaccinia synthetic late promoter, i.e., $P_{SL}$, and flanking TK gene regions of pCR-TK-SL-tTF-RGD are derived from an intermediate plasmid, TK-SL-CSF-3 (SEQ ID NO: 114), which contains the cDNA for GM-CSF under the control of the vaccinia synthetic late promoter flanked by the TK gene regions.

Plasmid pCR-SL3 (SEQ ID NO: 39; see (j) above for description of pCR-SL3), containing the vaccinia synthetic late promoter, i.e., $P_{SL}$, was used as the source of the vaccinia synthetic late promoter in generating vector TK-SL-CSF-3 (SEQ ID NO: 114). DNA encoding mouse GM-CSF was excised from pCRII-CSF9 (SEQ ID NO: 108) with SalI and EcoRI (blunt-ended after digestion), and cloned into vector pCR-SL3 (SEQ ID NO: 39) precut with SalI and SmaI, resulting in SL-CSF-3 (SEQ ID NO: 113). Thus, SL-CSF-3 contains the vaccinia synthetic late promoter ($P_{SL}$) operably linked to DNA encoding GM-CSF. The GM-CSF expression cassette containing DNA encoding GM-CSF under the control of the PSL was excised out from SL-CSF-3 by Sac I and cloned into the same-cut vector pCR-TKLR-gpt2 (SEQ ID NO: 17) to generate the construct TK-SL-CSF-3 (SEQ ID NO: 114). This cloning step places the ($P_{SL}$)GM-CSF expression cassette between the left and right TK gene flanking sequences in pCR-TKLR-gpt2 and eliminates the non-coding DNA that is located between these flanking sequences in pCR-TKLR-gpt2.

To generate vector pCR-TK-SL-tTF-RGD, the tTF-RGD fragment was released by SalI and PacI restriction enzyme digest of pCRII-tTF-RGD (see (n) above; SEQ ID NO: 94) and inserted into TK-SL-CSF-3 (SEQ ID NO: 114), precut with SalI and PacI to generate plasmid pCR-TK-SL-tTF-RGD (SEQ ID NO: 97), thus placing the tTF-RGD cDNA under the control of vaccinia virus synthetic late ($P_{SL}$) promoter and in between the left and right TK gene flanking sequences. The tTF-RGD cDNA insert was confirmed by sequencing.

q. pCR-TK-SE-G6-FLAG: For Insertion of an Expression Cassette Encoding the G6-FLAG Fusion Protein Under the Control of the Vaccinia $P_{SE}$ Promoter into the Vaccinia TK Locus Vector pCR-TK-SE-G6-FLAG (SEQ ID NO: 100) was employed to develop strain GLV-1h107 having the following genotype: F14.5L: ($P_{SEL}$)Ruc-GFP; TK: ($P_{SE}$) G6-FLAG; HA: ($P_{11k}$)gusA. Strain GLV-1h107 was generated by inserting DNA encoding a G6-FLAG fusion protein (SEQ ID NO: 99; G6 is the anti-VEGF scAb) into the TK locus of strain GLV-1h68 thereby deleting the rTrfR-LacZ expression cassette at the TK locus of strain GLV-1h68. Vector pCR-TK-SE-G6-FLAG contains a DNA fragment encoding the G6-FLAG fusion protein operably linked to the vaccinia synthetic early promoter ($P_{SE}$), sequences of the TK gene flanking the ($P_{SE}$)-fusion protein-encoding DNA fragment, the *E. coli* guanine phosphoribosyltransferase (gpt) gene under the control of the vaccinia virus P7.5k early and late promoter for transient dominant selection of virus that has incorporated the vector, and sequences of the pUC plasmid.

cDNA encoding G6-FLAG was obtained from vector pGA4-G6 (GeneArt; SEQ ID NO: 98). The vector contains DNA encoding an artificially synthesized single chain antibody (scAb) directed against VEGF (scFv anti-VEGF). The gene encodes the kappa light chain leader sequence for the secretion of the protein, the sequence of the $V_H$ domain of the scAb followed by a linker sequence and the sequence of the $V_L$ domain of the scAb. The C-terminal end of the gene is fused to DNA encoding a FLAG-tag for ease of protein detection. The 5' end the G6-FLAG fragment contains a SalI site, and the 3' end contains a PacI site.

To generate vector pCR-TK-SE-G6-FLAG, the G6-FLAG fragment was released by SalI and PacI restriction enzyme digest of pGA4-G6 (SEQ ID NO: 98) and inserted into TK-SE-CSF-2 (see (n) above; SEQ ID NO: 110), precut with SalI and PacI, to generate plasmid pCR-TK-SE-G6-FLAG (SEQ ID NO: 100), thus placing the G6-FLAG cDNA under the control of vaccinia virus synthetic early ($P_{SE}$) promoter and in between the left and right TK gene flanking sequences. The G6-FLAG cDNA insert was confirmed by sequencing.

r. pCR-TK-SEL-G6-FLAG: For Insertion of an Expression Cassette Encoding the G6-FLAG Fusion Protein Under the Control of the Vaccinia $P_{SEL}$ Promoter into the Vaccinia TK Locus Vector pCR-TK-SEL-G6-FLAG (SEQ ID NO: 101) was employed to develop strain GLV-1h108 having the following genotype: F14.5L: ($P_{SEL}$)Ruc-GFP; TK: ($P_{SEL}$)G6-FLAG; HA: ($P_{11k}$)gusA. Strain GLV-1h108 was generated by inserting DNA encoding a G6-FLAG fusion protein (SEQ ID NO: 99) into the TK locus of strain GLV-1h68 thereby deleting the rTrfR-LacZ expression cassette at the TK locus of strain GLV-1h68. Vector pCR-TK-SEL-G6-FLAG contains a DNA fragment encoding the G6-FLAG fusion protein operably linked to the vaccinia synthetic early/late promoter ($P_{SEL}$), sequences of the TK gene flanking the ($P_{SEL}$)-fusion protein-encoding DNA fragment, the *E. coli* guanine phosphoribosyltransferase (gpt) gene under the control of the vaccinia virus P7.5k early and late promoter for transient dominant selection of virus that has incorporated the vector, and sequences of the pUC plasmid.

To generate vector pCR-TK-SEL-G6-FLAG, the G6-FLAG fragment was released by SalI and PacI restriction enzyme digest of pGA4-G6 (see (q) above; SEQ ID NO: 98) and inserted into TK-SEL-CSF-2 (see (o) above; SEQ ID NO: 112), precut with SalI and PacI, to generate plasmid pCR-TK-SEL-G6-FLAG (SEQ ID NO: 101), thus placing the tTF-RGD cDNA under the control of vaccinia virus synthetic early/late ($P_{SEL}$) promoter and in between the left and right TK gene flanking sequences. The G6-FLAG cDNA insert was confirmed by sequencing.

s. pCR-TK-SL-G6-FLAG: For Insertion of an Expression Cassette Encoding the G6-FLAG Fusion Protein Under the Control of the Vaccinia $P_{SL}$ Promoter into the Vaccinia TK Locus Vector pCR-TK-SL-G6-FLAG (SEQ ID NO: 102) was employed to develop strain GLV-1h109 having the following genotype: F14.5L: ($P_{SEL}$)Ruc-GFP; TK: ($P_{SL}$) G6-FLAG; HA: ($P_{11k}$)gusA. Strain GLV-1h109 was generated by inserting DNA encoding a G6-FLAG fusion protein (SEQ ID NO: 99) into the TK locus of strain GLV-1h68 thereby deleting the rTrfR-LacZ expression cassette at the TK locus of strain GLV-1h68. Vector pCR-TK-SL-G6-FLAG contains a DNA fragment encoding the G6-FLAG fusion protein operably linked to the vaccinia synthetic late promoter ($P_{SL}$), sequences of the TK gene flanking the ($P_{SL}$)-fusion protein-encoding DNA fragment, the *E. coli* guanine phosphoribosyltransferase (gpt) gene under the control of the vaccinia virus P7.5k early and late promoter for transient dominant selection of virus that has incorporated the vector, and sequences of the pUC plasmid.

To generate vector pCR-TK-SL-G6-FLAG, the G6-FLAG fragment was released by SalI and PacI restriction enzyme digest of pGA4-G6 (see (q) above; SEQ ID NO: 98) and inserted into TK-SL-CSF-3 (see (p) above; SEQ ID NO: 114), precut with SalI and PacI to generate plasmid pCR-TK-SL-G6-FLAG (SEQ ID NO: 102), thus placing the G6-FLAG cDNA under the control of vaccinia virus synthetic late ($P_{SL}$) promoter and in between the left and right TK gene flanking sequences. The G6-FLAG cDNA insert was confirmed by sequencing.

t. pF14.5-SEL-RG: For Insertion of an Expression Cassette Encoding the Ruc-GFP Fusion Protein Under the Control of the Vaccinia $P_{SEL}$ Promoter into the Vaccinia F14.5L Locus pF14.5-SEL-RG (SEQ ID NO: 104) is a targeting vector that can be employed to facilitate insertion of foreign genes in the F14.5L locus of LIVP.

The ruc-gfp fusion cDNA from pcDNA-RG (see, for example, Wang et al., 2002) was amplified by PCR using AccuPrime pfx SuperMix (Invitrogen), using primer that comprise the vaccinia synthetic early/late promoter ($P_{SEL}$), which places the ruc-gfp under the control of $P_{SEL}$ promoter:

```
                                         (SEQ ID NO: 117)
5'-ATCAAGCTTAAAAATTGAAATTTTATTTTTTTTTTTGGAATATA
AATGACTTCGAAAGTTTATGATCCAGAAC-3'
and (SEQ ID NO: 118)
5'-TCACTTGTACAGCTCGTCCA-3'.
```

The resulting PCR product was cloned into pCR-Blunt II-TOPO vector (Invitrogen; SEQ ID NO: 40) to yield pCRII-SEL-RG (SEQ ID NO: 105). The vector was sequence confirmed.

To generate vector pF14.5-SEL-RG, the SEL-RG cDNA fragment was released from pCRII-SEL-RG (SEQ ID NO: 105) by Hind III and EcoR V restriction enzyme digest and inserted into pNCVVf14.5lT (SEQ ID NO: 11), precut with HindIII and BamHI (blunt ended) to generate plasmid pF14.5-SEL-RG (SEQ ID NO: 104), thus placing the Ruc-GFP fusion cDNA under the control of vaccinia virus synthetic early/late ($P_{SEL}$) promoter and in between the left and right F14.5L gene flanking sequences.

3. Preparation of Recombinant Vaccinia Viruses a. GLV-1i69

CV-1 (African green monkey kidney fibroblast) cells (ATCC No. CCL-70), grown in DMEM (Mediatech, Inc., Herndon, Va.) with 10% FBS, were infected with GLV-1h68 at multiplicity of infection (m.o.i.) of 0.1 for 1 hour, then transfected using Lipofectamine 2000 (Invitrogen, Carlsbad, Calif.) with PCR-amplified A34R (SEQ ID NO: 58) coding sequence from VV IHD-J using the following primers: 5'-CATTAATAAATGAAATCGCTTAATAG-3' (SEQ ID NO: 59) and 5'-GGCGGCGTACGTTAACGAC-3' (SEQ ID NO: 60). Recombinant virus was selected based on its comet-like plaque morphology as described below.

Two days after transfection, the medium was harvested. To enrich the recombinant extracellular enveloped viruses (EEVs) (i.e. to increase the percentage of recombinant EEV within the infected medium), CV-1 cells were infected with the infected/transfected medium. Two days post infection the infected medium was collected. After the fourth round of the enrichment, the infected medium was diluted and used to infect CV-1 cells. Ten well-isolated plaques were picked and purified for a total of three times. Eight of ten isolates formed comet-like plaques under liquid medium.

b. GLV-1h and GLV-1j Series

CV-1 cells, grown in DMEM (Mediatech, Inc., Herndon, Va.) with 10% FBS, were infected with the indicated parental viruses (Table 2) at m.o.i. of 0.1 for 1 hr, then transfected using Lipofectamine 2000 or Fugene (Roche, Indianapolis, Ind.) with 2 μg of the corresponding transfer vector (Table 2). Infected/transfected cells were harvested and the recombinant viruses were selected using a transient dominant selection system and plaque purified using methods known in the art (see, e.g., Falkner and Moss, J. Virol., 64, 3108-3111 (1990)). Isolates were plaque purified five times with the first two rounds of plaque isolation conducted in the presence of mycophenolic acid, xanthine and hypoxanthine which permits growth only of recombinant virus that expressed the selectable marker protein, i.e., E. coli guanine phosphoribosyltransferase (gpt), under the control of the vaccinia $P_{7.5kE}$ promoter. As described herein, each of the transfer vectors used in the generation of the GLV-1h and GLV-1j series of recombinant vaccinia virus contained a ($P_{7.5kE}$)gpt expression cassette. Thus, growth of the virus in the presence of the selection agents enabled identification of virus in which the first crossover event of homologous recombination between the transfer vector and the parental strain genome had occurred. Subsequent growth of the isolates in the absence of selection agents and further plaque purification yielded isolates that had undergone a second crossover event resulting in deletion of the DNA encoding guanine phosphoribosyltransferase from the genome. This was confirmed by the inability of these isolates to grow in the presence of selection agents.

4. Verification of Vaccinia Virus Strain Genotypes

The genotypes of the modified vaccinia virus strains were verified by PCR and restriction enzyme digestion. The nucleotide sequence of the coding sequence from the IHD-J A34R gene (SEQ ID NO: 58) in GLV-1i69 was further verified by sequencing. Lack of expression of the gusA gene in GLV-1h70, GLV-1h73, GLV-1h74, GLV-1h82, GLV-1h83, GLV-1h84, GLV-1h86, GLV-1h90, GLV-1h91 and GLV-1h92 was confirmed by X-GlcA (5-bromo-4-chloro-3-indolyl-β-D-glucuronic acid) staining of the infected cells. Viruses lacking gusA expression are unable to convert the X-GlcA substrate as indicated by lack of development of blue color in the assay as compared to a control strain (e.g. GLV-1h68). Lack of expression of the GFP gene in GLV-1h71, GLV-1h73, GLV-1h74, GLV-1h84, GLV-1h85, GLV-1h96, GLV-1h97 and GLV-1h98 was confirmed by fluorescence microscopy as compared to a control strain (e.g. GLV-1h68). Lack of expression of β-galactosidase in GLV-1h72, GLV-1h74, GLV-1h81, GLV-1h84, GLV-1h85, GLV-1h86, GLV-1h104, GLV-1h105, GLV-1h106, GLV-1h107, GLV-1h108 and GLV-1h109 was confirmed by X-gal (5-bromo-4-chloro-3-indolyl-β-D-galactopyranoside) staining of the infected cells. Viruses lacking lacZ expression are unable to convert the X-gal substrate as indicated by lack of development of blue color in the assay as compared to a control strain (e.g. GLV-1h68). Standard techniques for X-GlcA and X-gal viral staining and fluorescence microscopy were employed and are well-known in the art.

Expression of mRFP in GLV-1h84 was confirmed using a Leica DMI 6000 B fluorescence microscope at 2 days post-infection of CV-1 cells and compared to mock infected cells or non-mRFP expression strains (e.g., GLV-1h73). In one example, the GLV-1h84 infected cells expressed over 2.2× $10^{10}$ relative light units compared to no expression in the GLV-1h73 strain. Expression of firefly luciferase in GLV-1h84 was confirmed at two days post-infection of CV-1 cells performed using the Chroma-Glo luciferase assay systems (Promega) and relative light units (RLU) were measured using a Turner TD-20e luminometer.

B. Vaccinia Virus Purification

Ten T225 flasks of confluent CV-1 cells (seeded at $2\times10^7$ cells per flask the day before infection) were infected with each virus at m.o.i. of 0.1. The infected cells were harvested two days post infection and lysed using a glass Dounce homogenizer. The cell lysate was clarified by centrifugation at 1,800 g for 5 min, and then layered on a cushion of 36% sucrose, and centrifuged at 13,000 rpm in a HB-6 rotor, Sorvall RC-5B Refrigerated Superspeed Centrifuge for 2 hours. The virus pellet was resuspended in 1 ml of 1 mM Tris, pH 9.0, loaded on a sterile 24% to 40% continuous sucrose gradient, and centrifuged at 26,000 g for 50 min. The virus band was collected and diluted using 2 volumes of 1 mM Tris, pH 9.0, and then centrifuged at 13,000 rpm in a HB-6 rotor for 60 min. The final virus pellet was resuspended in 1 ml of 1 mM Tris, pH 9.0 and the titer was determined in CV-1 cells (ATCC No. CCL-70).

Example 2

In Vitro Virus Infection Studies

A. Cell Lines Employed for Virus Infection

A549 (human lung carcinoma, ATCC No. CCL-185), CV-1 (African green monkey kidney fibroblast, ATCC No. CCL-70), MRC-5 (human lung fibroblast, ATCC No. CCL-171), Vero (African green monkey kidney epithelial, ATCC No. CCL-81) and 293 (human kidney fibroblast, ATCC No. CRL-1573) cells were obtained from the American Type Culture Collection (ATCC; Manassas, Va.). GI-101A (human breast tumor) cells (obtained from Dr. Alex Aller, Rumbaugh—Goodwin Institute for Cancer Research, Inc., Plantation, Fla.) were derived from GI-101, a human ductal adenocarcinoma cell line (Rathinavelu et al., *Cancer Biochem. Biophys.*, 17:133-146 (1999)). Primary chick embryo fibroblasts (CEF) were prepared from 10-day-old embryos and grown in Ham's F-10 (Biowhittaker, Walkersville, Md.)/199 (1:1, Mediatech, Inc., Hemdon, Va.) supplemented with 5% heat-inactivated fetal bovine serum (FBS, Invitrogen, Carlsbad, Calif.), 2% nonessential amino acids (NEAA, Mediatech, Inc., Herndon, Va.) and 1% antibiotic-antimycotic solution (Mediatech, Inc., Hemdon, Va.). A549 cells were cultured in RPMI-1640 (Mediatech, Inc., Hermdon, Va.) supplemented with 10% FBS. CV-1 cells were grown in DMEM (Mediatech, Inc., Hemdon, Va.) with 10% FBS. MRC-5, Vero, and 293 cells were cultured in EMEM (Mediatech, Inc., Hemdon, Va.) supplemented with 10% FBS, 1% NEAA and 1% sodium pyruvate (Sigma, St. Louis, Mo.). GI-1A cells were grown in RPMI 1640 with 20% FBS, 1% antibiotic-antimycotic solution, 10 mM HEPES, 1% sodium pyruvate, 5 ng/ml of β-estradiol (Sigma, St. Louis, Mo.), and 5 ng/ml of progesterone (Sigma, St. Louis, Mo.). All cell lines were maintained at 37° C. with 5% $CO_2$ in a humidified incubator.

B. Analysis of Viral Yields in CV-1 Cells

The ability of modified vaccinia virus strains to infect and replicate in vitro was analyzed by measuring plaque forming units (PFU) produced following infection of CV-1 cells with purified recombinant virus, a technique well-known in the art. $2\times10^8$ CV-1 cells were infected with each virus at m.o.i. of 0.1 for 1 hour at 37° C. and harvested 2 days post infection. Each virus was purified through sucrose gradient and subjected to a plaque forming assay using CV-1 cells. Yields of purified virus for exemplary modified vaccinia virus strains are shown in Table 3.

TABLE 3

| Virus | Purified Virus Yield[a] |
|---|---|
| GLV-1h68 | $1.1 \times 10^9$ |
| GLV-1h70 | $1.1 \times 10^9$ |
| GLV-1h71 | $2.1 \times 10^9$ |
| GLV-1h72 | $1.9 \times 10^9$ |
| GLV-1h73 | $4.1 \times 10^9$ |
| GLV-h74 | $4.6 \times 10^9$ |

[a]Yield in PFU/$2 \times 10^8$ cells at 2 days post infection

C. Virus Production in Different Cell Lines

Experiment 1

Comparison of Virus Production in Different Cell Lines

A549, CEF, CV-1, MRC-5, Vero and 293 cells in 6-well plates were infected with GLV-1h68 or GLV-1h74 at m.o.i. of 0.01 for 1 hour at 37° C. The inoculum was aspirated and the cell monolayers were washed twice with 2 ml of DPBS (Mediatech, Inc., Hemdon, Va.). Two ml of cell culture medium were added into each well. Three wells of each cell type were harvested at 24 h, 48 h and 72 h post infection (PI), respectively. The virus titer in crude cell lysates from infected cells was determined in CV-1 cells. Data for yields of exemplary viruses GLV-1h68 and GLV-1h74 in different cell lines are shown in Table 4 and Table 5, respectively.

GLV-1h68 yields were high in all cells tested except for CEF cells. The virus yields in CV-1 and A549 cells on day 3 post-infection were quite similar, but slightly higher than that in MRC-5 cells, more than 3 times as high as that in Vero and 293 cells, and more than 1800 times as high as that in CEF cells. The cell lines that provided for significant virus yields are potential candidate cell lines for the GMP production of GLV-1h68. Since vaccinia virus has a very broad host range in vitro there can be other cell lines that support GLV-1h68 replication as well as, or better than, the cell lines tested, which can be used for the GMP production of GLV-1h68.

GLV-1h74 yields were high in all cells tested, including CEF cells. The highest yields of virus were obtained with CV-1 cells and A549 cells. The virus yield in CV-1 cells on day 3 post-infection was more than 1.7 times as high as that in A549 cells, about 3.5 times as high as that in MRC-5 and Vero cells, 6.2 times as high as that in 293 cells, and about 52 times as high as that in CEF cells. The yields of GLV-1h74 in all six cell lines tested were higher than the yields of GLV-1h68. The virus yields of GLV-1h74 in A549, CV-1, MRC-5, Vero and 293 cells were 3 to 8 times as high as that of GLV-1h68 in the same cell lines. Strikingly, the virus yield of GLV-1h74 in CEF cells was 278 times higher than that of GLV-1h68 in the same cell line. All cell lines tested are potential candidate cell lines for the GMP production of GLV-1h74 since they all supported GLV-1h74 replication very well. Since vaccinia virus has a very broad host range in vitro there can be other cell lines that can support GLV-1h74 replication as well as the cell lines tested or ever better, which can be used for the GMP production of GLV-1h74.

TABLE 4

Virus yields of GLV-1h68 in different cell lines

| | Virus Yield (PFU/$10^6$ Cells) | | | |
|---|---|---|---|---|
| Cell Type | Day 0 | Day 1 | Day 2 | Day 3 |
| A549 | $10^4 \pm 0$ | $4.3 \times 10^6 \pm 5.3 \times 10^4$ | $6.1 \times 10^7 \pm 7.6 \times 10^6$ | $8.1 \times 10^7 \pm 1.1 \times 10^7$ |
| CEF | $10^4 \pm 0$ | $1.8 \times 10^3 \pm 4.6 \times 10^2$ | $3.4 \times 10^4 \pm 6.3 \times 10^3$ | $4.3 \times 10^4 \pm 1.5 \times 10^4$ |
| CV 1 | $10^4 \pm 0$ | $6.3 \times 10^5 \pm 2.4 \times 10^4$ | $5.7 \times 10^7 \pm 8.9 \times 10^6$ | $1.0 \times 10^8 \pm 2.1 \times 10^6$ |
| MRC-5 | $10^4 \pm 0$ | $2.9 \times 10^5 \pm 4.0 \times 10^4$ | $3.7 \times 10^7 \pm 5.0 \times 10^6$ | $6.2 \times 10^7 \pm 5.8 \times 10^5$ |
| Vero | $10^4 \pm 0$ | $5.7 \times 10^4 \pm 8.8 \times 10^3$ | $1.2 \times 10^6 \pm 1.8 \times 10^5$ | $2.4 \times 10^7 \pm 4.0 \times 10^6$ |
| 293 | $10^4 \pm 0$ | $2.0 \times 10^5 \pm 6.4 \times 10^4$ | $1.5 \times 10^7 \pm 4.2 \times 10^6$ | $2.8 \times 10^7 \pm 7.3 \times 10^6$ |

TABLE 5

Virus yields of GLV-1h74 in different cell lines

| | Virus Yield (PFU/$10^6$ Cells) | | | |
|---|---|---|---|---|
| Cell Type | Day 0 | Day 1 | Day 2 | Day 3 |
| A549 | $10^4 \pm 0$ | $3.0 \times 10^7 \pm 2.2 \times 10^6$ | $2.6 \times 10^8 \pm 4.7 \times 10^7$ | $3.6 \times 10^8 \pm 3.8 \times 10^7$ |
| CEF | $10^4 \pm 0$ | $3.2 \times 10^4 \pm 7.6 \times 10^3$ | $5.9 \times 10^6 \pm 8.0 \times 10^5$ | $1.2 \times 10^7 \pm 3.6 \times 10^6$ |
| CV 1 | $10^4 \pm 0$ | $6.5 \times 10^6 \pm 7.0 \times 10^5$ | $3.2 \times 10^8 \pm 6.3 \times 10^7$ | $6.2 \times 10^8 \pm 3.5 \times 10^7$ |
| MRC-5 | $10^4 \pm 0$ | $3.1 \times 10^6 \pm 1.2 \times 10^5$ | $1.5 \times 10^8 \pm 9.7 \times 10^6$ | $1.7 \times 10^8 \pm 3.8 \times 10^7$ |
| Vero | $10^4 \pm 0$ | $2.8 \times 10^6 \pm 2.3 \times 10^5$ | $8.3 \times 10^7 \pm 7.0 \times 10^6$ | $1.8 \times 10^8 \pm 9.4 \times 10^6$ |
| 293 | $10^4 \pm 0$ | $2.9 \times 10^7 \pm 5.6 \times 10^6$ | $8.6 \times 10^7 \pm 1.1 \times 10^7$ | $1.0 \times 10^8 \pm 1.1 \times 10^7$ |

Experiment 2

Comparison of Modified Vaccinia Strains

CEF, MRC-5, or GI-101A cells in 6-well plates were infected with GLV-1h68 or its derivatives at m.o.i. of 0.01 for 1 hour at 37° C. The inoculum was aspirated and the cell monolayers were washed twice with 2 ml of DPBS (Mediatech, Inc., Herndon, Va.). Two ml of cell culture medium were added into each well. Three wells of each virus/cell type were harvested at 24, 48, and 72 h post infection (PI), respectively. The crude cell lysates were titrated in CV-1 cells.

Based on the viral yields in CEF cells, the viruses tested can be divided into two groups (Table 6). The virus yields in the first group (GLV-1h71, GLV-1h73, and GLV-1h74) were much better than those in the second group (GLV-1h68, GLV-1h70, and GLV-1h72). At all time points, the yields of the viruses in the first group were at least 10 times as high as that in the second group.

In the MRC-5 cell line, all viruses tested exhibited high virus yields (Table 7). In the first 24 hours, GLV-1h71, GLV-1h73, and GLV-1h74 had higher yields than did GLV-1h68, GLV-1h70 and GLV-1h72. On day 3, all viruses reached similar titers, except that the titer of GLV-1h74 was about 2 times as high as that of other viruses.

In the GI-101A cell line, all viruses except GLV-1h22 exhibited higher yields in the first day than did during the second day, and all viruses reached their maximum titers on day 2 (Table 8).

Overall, in all three cell lines tested, the virus lacking all foreign gene expression cassettes at all three loci (GLV-1h74) exhibited higher yields than did the virus lacking foreign gene expression cassettes at two loci (GLV-1h73) and much better yields than did the viruses lacking foreign gene expression cassette(s) at only one locus (GLV-1h70, 71, and 72). Also, all viruses had higher yields than their parental virus, GLV-1h68, indicating that foreign gene transcription and/or expression reduced vaccinia virus growth in vitro. The more foreign gene expression cassettes were replaced, the better the virus grew in vitro. Interestingly, among the viruses that have a foreign insert replaced at only one locus, GLV-1h71 consistently had higher yields than GLV-1h72, whereas GLV-1h72 always showed higher yields than GLV-1h70. Ruc-GFP fusion gene expression cassette that was replaced in GLV-1h71 consists of a synthetic early/later promoter that is stronger than the 11k promoter directing GUS expression replaced in GLV-1h70. It appears that stronger foreign gene expression exerts a stronger negative effect on virus replication, although it cannot be ruled out that different foreign proteins might have different effects on virus growth. Replacement of the insert at TK locus in GLV-1h72 that contains a strong synthetic early/late promoter directing transcription of an anti-sense strand of a transferrin receptor and a 7.5 k early/late promoter controlling LacZ expression resulted in more enhanced virus replication than did replacing an insert containing 11k promoter directing GUS expression in GLV-1h70, although the 11k promoter is much stronger than 7.5 k promoter, indicating that transcription in the absence of translation also appeared to have negative effects on virus yields in vitro.

TABLE 6

Virus Yields of Different Vaccinia Recombinants in CEF Cells

| PI | Virus Yield (PFU/$10^6$ Cells) | | | | | |
|---|---|---|---|---|---|---|
| (hr) | GLV-1h68 | GLV-1h70 | GLV-1h71 | GLV-1h72 | GLV-1h73 | GLV-1h74 |
| 0 | $1.0 \times 10^4$ | $1.0 \times 10^4$ | $1.0 \times 10^4$ | $1.0 \times 10^4$ | $1.0 \times 10^4$ | $1.0 \times 10^4$ |
| 24 | $2.9 \times 10^3 \pm$ | $1.4 \times 10^3 \pm$ | $3.5 \times 10^4 \pm$ | $3.1 \times 10^3 \pm$ | $7.7 \times 10^4 \pm$ | $1.1 \times 10^5 \pm$ |

TABLE 6-continued

Virus Yields of Different Vaccinia Recombinants in CEF Cells

| PI | Virus Yield (PFU/$10^6$ Cells) | | | | | |
|---|---|---|---|---|---|---|
| (hr) | GLV-1h68 | GLV-1h70 | GLV-1h71 | GLV-1h72 | GLV-1h73 | GLV-1h74 |
| | $9.1 \times 10^2$ | $3.7 \times 10^2$ | $5.9 \times 10^3$ | $6.0 \times 10^2$ | $1.7 \times 10^4$ | $1.3 \times 10^4$ |
| 48 | $2.2 \times 10^5 \pm$ | $1.7 \times 10^5 \pm$ | $5.9 \times 10^6 \pm$ | $1.9 \times 10^5 \pm$ | $7.4 \times 10^6 \pm$ | $1.2 \times 10^7 \pm$ |
| | $4.3 \times 10^4$ | $5.4 \times 10^4$ | $4.5 \times 10^5$ | $1.1 \times 10^5$ | $8.7 \times 10^5$ | $9.6 \times 10^6$ |
| 72 | $1.2 \times 10^6 \pm$ | $2.5 \times 10^6 \pm$ | $2.7 \times 10^7 \pm$ | $2.8 \times 10^6 \pm$ | $3.4 \times 10^7 \pm$ | $4.9 \times 10^7 \pm$ |
| | $9.7 \times 10^4$ | $1.3 \times 10^6$ | $1.0 \times 10^7$ | $6.9 \times 10^5$ | $1.5 \times 10^7$ | $1.9 \times 10^7$ |

TABLE 7

Virus Yields of Different Vaccinia Recombinants in MRC-5 Cells

| PI | Virus Yield (PFU/$10^6$ Cells) | | | | | |
|---|---|---|---|---|---|---|
| (hr) | GLV-1h68 | GLV-1h70 | GLV-1h71 | GLV-1h72 | GLV-1h73 | GLV-1h74 |
| 0 | $1.0 \times 10^4$ | $1.0 \times 10^4$ | $1.0 \times 10^4$ | $1.0 \times 10^4$ | $1.0 \times 10^4$ | $1.0 \times 10^4$ |
| 24 | $9.9 \times 10^4 \pm$ | $9.9 \times 10^4 \pm$ | $6.0 \times 10^5 \pm$ | $1.2 \times 10^5 \pm$ | $1.2 \times 10^6 \pm$ | $2.0 \times 10^6 \pm$ |
| | $4.9 \times 10^3$ | $1.6 \times 10^4$ | $2.3 \times 10^5$ | $7.1 \times 10^3$ | $1.4 \times 10^5$ | $2.2 \times 10^5$ |
| 48 | $1.3 \times 10^7 \pm$ | $1.4 \times 10^7 \pm$ | $2.7 \times 10^7 \pm$ | $2.7 \times 10^7 \pm$ | $3.6 \times 10^7 \pm$ | $6.9 \times 10^7 \pm$ |
| | $2.4 \times 10^6$ | $1.3 \times 10^6$ | $8.0 \times 10^5$ | $5.8 \times 10^6$ | $8.4 \times 10^6$ | $2.3 \times 10^7$ |
| 72 | $3.4 \times 10^7 \pm$ | $4.9 \times 10^7 \pm$ | $3.3 \times 10^7 \pm$ | $4.5 \times 10^7 \pm$ | $4.0 \times 10^7 \pm$ | $8.1 \times 10^7 \pm$ |
| | $3.5 \times 10^6$ | $1.8 \times 10^7$ | $6.4 \times 10^6$ | $6.9 \times 10^6$ | $9.2 \times 10^6$ | $1.4 \times 10^7$ |

TABLE 8

Virus Yields of Different Vaccinia Recombinants in GI-101A Cells

| PI | Virus Yield (PFU/$10^6$ Cells) | | | | | | |
|---|---|---|---|---|---|---|---|
| (hr) | GLV-1h22 | GLV-1h68 | GLV-1h70 | GLV-1h71 | GLV-1h72 | GLV-1h73 | GLV-1h74 |
| 0 | $1.0 \times 10^4$ | $1.0 \times 10^4$ | $1.0 \times 10^4$ | $1.0 \times 10^4$ | $1.0 \times 10^4$ | $1.0 \times 10^4$ | $1.0 \times 10^4$ |
| 24 | $2.2 \times 10^5 \pm$ | $3.0 \times 10^5 \pm$ | $3.5 \times 10^5 \pm$ | $1.1 \times 10^6 \pm$ | $3.9 \times 10^5 \pm$ | $2.5 \times 10^6 \pm$ | $23.7 \times 10^6 \pm$ |
| | $5.5 \times 10^3$ | $1.1 \times 10^4$ | $2.4 \times 10^4$ | $1.3 \times 10^5$ | $2.2 \times 10^4$ | $1.5 \times 10^5$ | $3.3 \times 10^5$ |
| 48 | $2.5 \times 10^6 \pm$ | $8.8 \times 10^5 \pm$ | $1.5 \times 10^6 \pm$ | $4.1 \times 10^6 \pm$ | $2.2 \times 10^6 \pm$ | $1.1 \times 10^7 \pm$ | $2.1 \times 10^7 \pm$ |
| | $6.8 \times 10^5$ | $2.1 \times 10^4$ | $2.2 \times 10^5$ | $9.8 \times 10^5$ | $2.7 \times 10^5$ | $9.0 \times 10^5$ | $2.2 \times 10^6$ |
| 72 | $5.6 \times 10^5 \pm$ | $7.3 \times 10^5 \pm$ | $1.0 \times 10^6 \pm$ | $2.6 \times 10^6 \pm$ | $1.3 \times 10^6 \pm$ | $5.1 \times 10^6 \pm$ | $8.5 \times 10^6 \pm$ |
| | $2.3 \times 10^5$ | $7.4 \times 10^4$ | $2.2 \times 10^5$ | $2.5 \times 10^5$ | $2.2 \times 10^5$ | $4.0 \times 10^5$ | $1.4 \times 10^6$ |

D. Plaque Size Following Viral Infection of GI-101A Cells

GLV-1h68, GLV-1h73 and GLV-1h74 were tested for plaque formation in GI-101A cells. GLV-1h73 consistently formed larger plaques in GI-101A cells than GLV-1h68 did. GLV-1h74 also consistently formed larger plaques in GI101A cells compared to GLV-1h68. This data is consistent with the higher viral yields of the GLV-1h73 and GLV-1h74 strains as compared to GLV-1h68.

E. Comparison of Virion Type Produced by Strains GLV-1h68 and GLV-1i69

Vaccinia virus makes three forms of infectious virions during its life cycle: IMV (intracellular enveloped virus), CEV (cell-associated enveloped virus) and EEV (extracellular enveloped virus). IMVs are made in virus factories within the infected cells and stay there until cell lysis. CEVs have one additional membrane compared to IMVs and are retained on the cell surface. EEVs have identical structures to CEV, but are dissociated from the cell. IMVs are very stable virions, which are important for virus transmission between hosts. CEVs are required for efficient cell-to-cell spread. EEVs mediate long-range virus transmission and are relatively resistant to host immune reactions. Because EEVs can be more resistant to host immune attacks than IMVs, EEVs should better survive transit from an initial delivery site to a tumor in animals and humans than IMVs, and hence have can have advantages as a therapeutic agent for cancer therapy not possessed by IMVs.

The relative levels of cell-associated virus (includes IMV plus CEV forms) and EEV were assessed for strains GLV-1h68 and GLV-1i69 by standard plaque assay (Table 9). $5 \times 10^5$ CV-1 cells were infected in triplicate with each virus at m.o.i. of 10 and the supernatant (EEV) and infected cells (cell-associated virus) were harvested 24 hours post infection. Both EEV and cell-associated virus were titrated in CV-1 cells using standard protocols. Viral yields of cell-associated virus versus extracellular enveloped virus (EEV) are shown in Table 9.

Most vaccinia virus strains, including GLV-1h68, produce a majority of IMVs whereas EEVs only represent a very small portion of virions made during infection. The VV A34R gene product is involved in the release of cell-associated enveloped virus (CEV) from infected cell membranes to form EEV. The proteins encoded by the A34R genes of the GLV-1h68 and WR VV strains have identical amino acid sequences, whereas the proteins encoded by the A34R genes of the WR (or GLV-1h68) and IHD-J strains differ by two amino acids (Asp 110 (GLV-1h68)→Asn (1HD-J) and Lys 151 (GLV-1h68)→Glu (1HD-J); compare SEQ ID NO: 61 and SEQ ID NO: 58). One of the mutations, Lys 151 (WR)→Glu (1HD-J) was shown to enhance the release of EEV (Blasco et al., *J. Virol.*, 67, 3319-3325, 1993). GLV-1i69 is a derivative of GLV-1h68, in which the GLV-1h68 A34R gene coding sequence (nucleotides 153693 to 154199 of SEQ ID NO: 1) was replaced with the A34R gene coding sequence from vaccinia virus IHD-J strain (SEQ ID NO: 58). Vaccinia virus IHD-J produced up to 40 times more extracellular enveloped virus (EEV) than did VV WR strain (Blasco et al., *J. Virol.*, 67, 3319-3325, 1993) and GLV-1h68 produced 8 times as many EEVs as GLV-1h68 did, while both GLV-1i69 and GLV-1h68 viruses made a similar amount of cell associated viruses (i.e. IMV plus CEV) 24 hours post infection. GLV-1i69 formed comet-like plaques under liquid medium in vitro as a result of A34R gene coding sequence replacement, whereas GLV-1h68 generated sharply defined round plaques, indicating that GLV-1i69 spread faster than GLV-1h68 in vitro. GLV-1i69 thus exhibits enhanced spreading capability, a characteristic desired in a therapeutic agent for cancer virotherapy, and also can serve as a better source of EEVs than GLV-1h68.

TABLE 9

Yields of EEVs and cell associated viruses of GLV-1h68 and GLV-1i69 in CV-1 cells

| Virus | Titer (PFU/$10^6$ cells) |
| --- | --- |
| GLV-1h68, cell associated virus | $1.2 \times 10^7 \pm 1.8 \times 10^6$ |
| GLV-1i69, cell associated virus | $1.1 \times 10^7 \pm 1.5 \times 10^6$ |
| GLV-1h68, EEV | $7.4 \times 10^4 \pm 2.2 \times 10^3$ |
| GLV-1i69, EEV | $5.8 \times 10^5 \pm 5 \times 10^4$ |

Example 3

In vivo Viral Distribution

A. In Vivo Virus Distribution in Nude Mice with Human Breast Tumor Xenografts

The ability of the vaccinia viral strains to accumulate in tumor tissue relative to other tissues was assessed by infecting nude mice that were implanted with breast cancer cells in order to form tumors. $5 \times 10^6$ GI-10A cells in 100 μl of PBS were injected s.c. into the right lateral thigh of female nude mice, 5 weeks of age, and allowed to grow for 33 days. Groups of 4 mice (for each mutant virus strain) were infected via injection into the femoral vein with $5 \times 10^6$ PFU in 100 μl of PBS of GLV-1h22, GLV-1h68, GLV-1h70, GLV-1h71, GLV-1h72, GLV-1h73, or GLV-1h74. Two weeks post injection, all mice from each group were sacrificed, and tissue samples were homogenized using MagNA lyser (Roche Diagnostics, Indianapolis, Ind.) at speed of 6,500 for 30 seconds. The viral titers were determined in duplicate by the standard plaque assay using CV-1 cells. Results of virus tissue distribution are shown in Table 10 below.

Ovary: No virus was found in the ovaries of the mice infected with GLV-1h22, GLV-1h68, GLV-1h70, GLV-1h71 or GLV-1h73. A moderate amount of viruses were found in the ovaries of one out of a total of 4 mice infected with GLV-1h72 or GLV-1h74.

Bladder: No virus was found in the bladders of the mice infected with GLV-1h22, GLV-1h68, GLV-1h71, GLV-1h72 or GLV-1h74. A small amount of viruses were found in the bladders of one out of a total of 4 mice infected with GLV-1h70 or GLV-1h73.

Kidney: A small to moderate amount of viruses were found in the kidneys of 50% or more of mice infected with GLV-1h70, GLV-1h72, GLV-1h73 or GLV-1h74, with mice infected with GLV-1h74 having highest viral titer in the kidney; whereas only small amounts of viruses were found in the kidneys of one mouse infected with GLV-1h22, GLV-1h68 or GLV-1h71.

Adrenal Gland: No virus was found in adrenal glands in any of the infected mice, except for one mouse infected with GLV-1h72.

Spleen: Moderate amounts of virus particles were found in spleens of all mice infected with GLV-1h68, GLV-1h70, GLV-1h72, GLV-1h73, or GLV-1h74. A smaller amount of viruses were found in spleens of only three out of 4 mice infected with GLV-1h71, and one out of four mice infected with GLV-1h22.

Pancreas: No virus was found in the pancreases of GLV-1h22, GLV-1h71, GLV-1h72, and GLV-1h73 infected mice, and only small amounts of viruses were found in pancreases of two mice infected with GLV-1h74, and one mouse each infected with GLV-1h68 or GLV-1h70.

Lung: Moderate amounts of viruses were found in lungs of all infected mice. Mice infected with GLV-1h74 exhibited the highest viral titer, whereas mice infected with GLV-1h71 had the lowest viral titer in the lung.

Heart: Moderate amounts of viruses were found in hearts of mice infected with GLV-1h74, and only small amount of viruses were found in the hearts of two mice each infected with GLV-1h22 or GLV-1h68, and one mouse each infected with GLV-1h70, GLV-1h71, GLV-1h72, GLV-1h73 or GLV-1h74.

Brain: No virus was found in brains of any infected mice, except for one mouse infected with GLV-1h70.

Serum: No virus was found in the sera of mice infected with GLV-1h22 or GLV-1h71. Small amounts of viruses were found in sera of 3 mice infected with GLV-1h68 or GLV-1h74, two mice infected with GLV-1h70, and one mouse each infected with GLV-1h72 or GLV-1h73.

Liver: No virus was found in the livers of mice infected with GLV-1h68 or GLV-1h72. Small to moderate amounts of viruses were found in livers of all mice infected with GLV-1h73 or GLV-1h74, three mice infected with GLV-1h70, and one mouse each infected with GLV-1h22 or GLV-1h71, respectively.

Tumor: A large number of infectious virus particles were found in tumors of all infected mice, with mice infected with GLV-1h74 having highest viral titer, whereas mice infected with GLV-1h22 had the lowest viral titer in the tumor.

In summary, the lung and tumor are the only two organs where viruses were found in all infected mice. Viruses also were found in spleens in most of the infected mice. Although the titer of GLV-1h71 in tumors was five times as high as that of GLV-1h22, both viruses had similar and lower viral titers in most of the organs tested compared with the mice infected with other viruses. The removal of Ruc-GFP expression cassette from GLV-1h68, which yielded GLV-1h71 derivative, increased the viral titer in tumors and decreased the viral titers in other organs. The removal of the gusA expression cassette from GLV-1h68, which yielded GLV-1h70 derivative, resulted in a large increase in the viral titer in the liver, more than a two-fold increase in viral titer in spleen compared to GLV-1h68, and a slight increase in viral titer in the tumor. Deletion of the LacZ expression cassette, which yielded GLV-1h72 derivative, increased the viral titer in the tumor, but had less impact on the in vivo virus distribution in other organs than the removal of gusA expression cassette did, although the viral titer of GLV-1h72 in the kidney was more than two times as high as that of GLV-1h68. The viral titers of GLV-1h73, in which both gusA and Ruc-GFP expression cassettes were deleted, were found to be lower than that of GLV-1h70 in most of the organs except tumors, and were similar to that of GLV-1h68 except that the viral titers of GLV-1h73 in kidneys and tumors were significantly higher than that of GLV-1h68. The viral titers of GLV-1h74, in which all three foreign genes (i.e. Ruc-GFP, gusA and LacZ expression cassettes) were deleted, resulted in increases in viral titers in most of organs tested.

TABLE 10

Virus Distribution in Nude Mice with Human Breast Tumor Xenografts
2 weeks post-injection, PFU/g for tissue or PFU/ml for serum

| Organ | GLV-1h22 | GLV-1h68 | GLV-1h70 | GLV-1h71 | GLV-1h72 | GLV-1h73 | GLV-1h74 |
|---|---|---|---|---|---|---|---|
| Ovary | 0 | 0 | 0 | 0 | $2.1 \times 10^4 \pm 3.5 \times 10^4$ (1)* | 0 | $3.8 \times 10^3 \pm 6.6 \times 10^3$ (1)* |
| Bladder | 0 | 0 | $6.8 \times 10^2 \pm 1.2 \times 10^3$ (1)* | 0 | 0 | $3.3 \times 10^2 \pm 5.6 \times 10^2$ (1)* | 0 |
| Kidney | $35 \pm 60$ (1)* | $1.6 \times 10^2 \pm 2.7 \times 10^2$ (1)* | $94 \pm 56$ (3)* | $31 \pm 53$ (1)* | $3.9 \times 10^2 \pm 6.1 \times 10^2$ (2)* | $66 \pm 66$ (2)* | $2.8 \times 10^3 \pm 4.4 \times 10^3$ (3)* |
| Adrenal glands | 0 | 0 | 0 | 0 | $2.1 \times 10^4 \pm 3.7 \times 10^4$ (1)* | 0 | 0 |
| Spleen | $1.7 \times 10^2 \pm 2.9 \times 10^2$ (1)* | $7.2 \times 10^2 \pm 4.2 \times 10^2$ (4)* | $1.7 \times 10^3 \pm 6.3 \times 10^2$ (4)* | $5.9 \times 10^2 \pm 4.6 \times 10^2$ (3)* | $7.9 \times 10^2 \pm 8.0 \times 10^2$ (4)* | $6.7 \times 10^2 \pm 2.4 \times 10^2$ (4)* | $9.4 \times 10^2 \pm 5.6 \times 10^2$ (4)* |
| Pancreas | 0 | $68 \pm 120$ (1)* | $75 \pm 130$ (1)* | 0 | 0 | 0 | $1.7 \times 10^2 \pm 1.9 \times 10^2$ (2)* |
| Lung | $6.5 \times 10^3 \pm 6.2 \times 10^3$ (4)* | $9.5 \times 10^3 \pm 2.5 \times 10^3$ (4)* | $1.2 \times 10^4 \pm 3.8 \times 10^3$ (4)* | $3.5 \times 10^3 \pm 3.3 \times 10^3$ (4)* | $5.9 \times 10^3 \pm 5.7 \times 10^3$ (4)* | $8.1 \times 10^3 \pm 4.1 \times 10^3$ (4)* | $1.9 \times 10^4 \pm 2.3 \times 10^3$ (4)* |
| Heart | $1.1 \times 10^2 \pm 1.1 \times 10^2$ (2)* | $94 \pm 94$ (2)* | $54 \pm 94$ (1)* | $42 \pm 73$ (1)* | $53 \pm 91$ (1)* | $50 \pm 86$ (1)* | $1.3 \times 10^3 \pm 1.1 \times 10^3$ (4)* |
| Brain | 0 | 0 | $5.8 \times 10^2 \pm 1.0 \times 10^3$ (1)* | 0 | 0 | 0 | 0 |
| Serum | 0 | $50 \pm 35$ (3)* | $25 \pm 25$ (2)* | 0 | $13 \pm 22$ (1)* | $13 \pm 22$ (1)* | $38 \pm 22$ (3)* |
| Liver | $24 \pm 42$ (1)* | 0 | $1.1 \times 10^4 \pm 1.8 \times 10^4$ (3)* | $26 \pm 44$ (1)* | 0 | $6.3 \times 10^3 \pm 1.1 \times 10^4$ (4)* | $410 \pm 99$ (4)* |
| Tumor | $9.4 \times 10^7 \pm 9.5 \times 10^7$ (4)* | $3.8 \times 10^8 \pm 3.8 \times 10^8$ (4)* | $4.5 \times 10^8 \pm 3.6 \times 10^8$ (4)* | $4.7 \times 10^8 \pm 2.9 \times 10^8$ (4)* | $7.1 \times 10^8 \pm 4.1 \times 10^8$ (4)* | $1.0 \times 10^9 \pm 2.4 \times 10^8$ (4)* | $1.3 \times 10^9 \pm 2.5 \times 10^8$ (4)* |

B. Correlation Between In Vitro and In Vivo Viral Titers

A comparison was made between the in vitro titers of GLV-1h22, GLV-1h68, GLV-1h70, GLV-1h71, GLV-1h72, GLV-1h73, or GLV-1h74 infected GI-101A cells (Example 1B) versus the respective in vivo viral titers recovered from the tumor tissues 2 weeks after virus injection (Example 3A). A summary of the foreign gene insertions in the viral genome of LIVP and their effects on in vitro versus in vivo viral titers is shown in Table 11. There is a strong correlation between the in vitro and the in vivo data, indicating that the replication of the recombinant VV strains in the tumors can be well predicted from its replication in the cell cultures.

The viral titers recovered from the tumor tissues also were compared to the numbers of the inserted expression cassettes that were expressed by the recombinant virus GLV-1h22, GLV-1h68, GLV-1h70, GLV-1h71, GLV-1h72, GLV-1h73, and GLV-1h74, respectively. There is a strong negative correlation between viral titer and the number of inserted expression cassettes, indicating that when F14.5L, TK, and HA loci were all disrupted, the greater the number of the foreign gene expression cassettes that were inserted into these three loci in the viral genome, the greater the strain that was put on virus replication, thus producing a more attenuated virus.

TABLE 11

Comparison of Viral Yields versus Number of Heterologous Inserts

| Virus Name | Virus Genotype | | | Virus Yields | | Number of Inserts[c] |
|---|---|---|---|---|---|---|
| | F14.5L | TK | HA | In vitro virus yield[a] | In vivo virus yield[b] | |
| GLV-1h22 | pE/L-Ruc-GFP | p7.5k-lacZ pE/L-TFR | p11k-gusA | $5.6 \times 10^5$ | $9.4 \times 10^7$ | 4 |
| GLV-1h68 | pE/L-Ruc-GFP | p7.5k-lacZ (pE/L-rTFR) | p11k-gusA | $7.3 \times 10^5$ | $3.8 \times 10^8$ | 3 |
| GLV-1h70 | pE/L-Ruc-GFP | p7.5k-lacZ (pE/L-rTFR) | — | $1.0 \times 10^6$ | $4.5 \times 10^8$ | 2 |
| GLV-1h71 | — | p7.5k-lacZ (pE/L-rTFR) | p11k-gusA | $2.6 \times 10^6$ | $4.7 \times 10^8$ | 2 |
| GLV-1h72 | pE/L-Ruc-GFP | — | p11k-gusA | $1.3 \times 10^6$ | $7.1 \times 10^8$ | 2 |
| GLV- | — | p7.5k- | — | $5.1 \times 10^6$ | $1.0 \times 10^9$ | 1 |

TABLE 11-continued

Comparison of Viral Yields versus Number of Heterologous Inserts

| Virus Name | Virus Genotype | | | Virus Yields | | Number of Inserts[c] |
|---|---|---|---|---|---|---|
| | F14.5L | TK | HA | In vitro virus yield[a] | In vivo virus yield[b] | |
| 1h73 | | lacZ (pE/L-rTFR) | | | | |
| GLV-1h74 | — | — | — | $8.5 \times 10^6$ | $1.3 \times 10^9$ | 0 |

[a] $1.0 \times 10^6$ GI-101A cells were infected with each virus at m.o.i. of 0.01 and harvested 3 days PI.
[b] Viral titers in tumor tissue recovered 2 weeks post-injection ($5 \times 10^6$ PFU/mouse, i.v.) from nude mice with implanted GI-101A tumors.
[c] Only insertions which were expressed by the virus are counted.

Example 4

Effects of Modified Viruses on Survival and Tumor Growth In vivo

A. Effects of Viruses Administered to Female Nude Mice on S.C. Human Breast Tumor Xenografts Experiment 1

The in vivo effects of GLV-1h22, GLV-1h68, GLV-1h70, GLV-1h71, GLV-1h72, GLV-1h73 and GLV-1h74 were evaluated using a mouse model of breast cancer. Tumors were established in nude mice by subcutaneously injecting GI-101A human breast carcinoma cells (s.c. on the right lateral thigh; $5 \times 10^6$ cells; GI-101A cells: Rumbaugh-Goodwin Institute for Cancer Research Inc. Plantation, Fla.; U.S. Pat. No. 5,693,533) into female nude mice (Hsd:Athymic Nude-Foxn1$^{nu}$; Harlan, Indianapolis, Ind.) (n=4-8). Thirty three days following tumor cell implantation, seven groups of mice (n=3-6) were injected intravenously [in 100 µl of PBS, through femoral vein under anesthesia] with $5 \times 10^6$ PFU of GLV-1h22, GLV-1h68, GLV-1h70, GLV-1h71, GLV-1h72, GLV-1h73 and GLV-1h74, respectively. The control group of mice was not given any treatment. Tumor volume (mm$^3$) was measured at 33, 36, 43, 50, 57, 64, 71, 78, 82, 85, 89, 92, 97, and 102 days post-cancer cell injection. Results of median tumor volume are provided in Table 12. Each virus provided for a decrease in median tumor volume relative to uninfected control mice. GLV-1h73 exhibited the best tumor therapy efficacy with a median tumor volume of only 4% that of uninfected controls after 97 days of tumor growth. GLV-1h70, GLV-1h71, and GLV-1h72 show significantly better tumor therapy efficacy than GLV-1h68 with median tumor volumes of 20% (GLV-1h70), 19% (GLV-1h71), 25% (GLV-1h72), and 33% (GLV-1h68) of that of uninfected controls after 97 days of tumor growth. GLV-1h22 could arrest tumor growth overtime; however, during the time period used in this study, tumor growth was not reversed in mice to which GLV-1h22 was administered. GLV-1h74 was able to reverse tumor growth with high efficacy; however this strain was also toxic at this dose and over the extended time period (see Table 12).

TABLE 12

Median tumor volumes at different time points after i.v. injection of different virus strains into nude mice bearing GI-101A tumors

| | Median tumor volume (mm$^3$) | | | | | | | |
|---|---|---|---|---|---|---|---|---|
| Days post-implantation | Control (n = 3) | GLV-1h22 (n = 6) | GLV-1h68 (n = 5) | GLV-1h70 (n = 4) | GLV-1h71 (n = 6) | GLV-1h72 (n = 4) | GLV-1h73 (n = 6) | GLV-1h74 (n = 6) |
| 33 | 240.8 | 261.8 | 248.4 | 216.8 | 208.3 | 157.2 | 280.3 | 301.9 |
| 36 | 263.6 | 273.5 | 243.8 | 286.0 | 267.1 | 155.6 | 310.9 | 416.9 |
| 43 | 579.1 | 536.1 | 550.4 | 463.4 | 543.3 | 320.1 | 679.0 | 660.6 |
| 50 | 636.4 | 701.4 | 761.3 | 706.6 | 721.3 | 476.3 | 864.1 | 828.6 |
| 57 | 671.6 | 978.4 | 852.0 | 985.5 | 936.1 | 695.0 | 1117.9 | 897.4 |
| 64 | 904.3 | 1203.2 | 1118.2 | 1134.1 | 1154.1 | 950.6 | 1193.6 | 665.6 |
| 71 | 1235.9 | 1269.4 | 1302.0 | 1147.3 | 1316.2 | 1053.6 | 678.6 | * |
| 78 | 1431.8 | 1437.5 | 1225.2 | 1091.2 | 1069.1 | 1120.0 | 373.1 | * |
| 82 | 1888.1 | 1537.9 | 1233.5 | 1084.7 | 802.1 | 1014.8 | 237.0 | * |
| 85 | 2166.5 | 1448.5 | 1295.9 | 1141.7 | 732.3 | 1118.0 | 203.5 | * |
| 89 | 2548.0 | 1536.1 | 1083.2 | 961.3 | 600.6 | 842.2 | 174.3 | * |
| 92 | 2715.6 | 1485.4 | 1053.6 | 852.0 | 606.4 | 751.8 | 166.7 | * |
| 97 | 2918.3 | 1536.9 | 962.2 | 579.2 | 546.9 | 720.1 | 117.8 | * |

* No median tumor volume was calculated due to the death of significant numbers of mice.

Experiment 2

In a separate experiment, the in vivo effects of GLV-1h22, GLV-1h68, GLV-1h82, GLV-1h83, GLV-1h84, GLV-1h85 and GLV-1h86 were evaluated using the mouse GI-101A breast cancer model. Tumors were established in female nude mice by s.c. injection $5\times10^6$ GI-101A human breast carcinoma cells into the right lateral thigh (n=4-8). Thirty eight days following tumor cell implantation, eight groups of mice were injected intravenously with $5\times10^6$ PFU of GLV-1h22, GLV-1h68, GLV-1h82, GLV-1h83, GLV-1h84, GLV-1h85 and GLV-1h86, respectively, into the femoral vein. Tumor volume ($mm^3$) was measured at 39, 47, 54, 62, 68, 75, and 83 days post-cancer cell injection. Results of median tumor volume are provided in Table 13.

TABLE 13

Median tumor volumes at different time points after i.v. injection of different virus strains into nude mice bearing GI-101A tumors

| Days post-implantation of tumor cells | Median tumor volume ($mm^3$) | | | | | | | |
|---|---|---|---|---|---|---|---|---|
| | GLV-1h22 | GLV-1h68 | GLV-1h73 | GLV-1h82 | GLV-1h83 | GLV-1h84 | GLV-1h85 | GLV-1h86 |
| 39 | 412.9 | 350.2 | 341.1 | 353.4 | 392.25 | 305.6 | 350.65 | 419.55 |
| 47 | 750.4 | 722.3 | 819.8 | 1081.2 | 1222.25 | 604.3 | 914 | 962.1 |
| 54 | 1154.3 | 1301.45 | 1234.2 | 1075.3 | 1168.75 | 985.6 | 1212.8 | 1279.8 |
| 62 | 1424.4 | 1390.35 | 983.2 | 1319.2 | 1686.05 | 982 | 947.2 | 1397.55 |
| 68 | 1849.8 | 1581.15 | 855.45 | 1608.9 | 2061.5 | 1119.2 | 636.9 | 1269.2 |
| 75 | 1907.5 | 1528.95 | 517.3 | 1211.8 | 1856.35 | 614.25 | 255.25 | 689.6 |
| 83 | 1973.6 | 1405.5 | 172.9 | 1017.8 | 1824.35 | * | * | 361.25 |
| 89 | 1887.6 | 1181.4 | 74.4 | 855.9 | 1392.0 | * | * | 187.5 |

* No median tumor volume was calculated due to the death of significant numbers of mice.

B. Effects of Viruses on Body Weight and Survival of Tumor-Bearing Mice

1. Post-Infection Survival

The survival rates following i.v. administration of vaccinia strains to nude mice bearing s.c. human breast tumor xenografts were recorded and found to vary significantly among the different vaccinia strains tested. GLV-1h74 exhibited the highest toxicity with only 17% of mice infected surviving the duration of the experiment. In comparison, all mice infected with GLV-1h22 and GLV-1h71, 67% of mice infected with GLV-1h68 and GLV-1h72, and 50% of mice infected with GLV-1h70 and GLV-1h73 survived the duration of the experiment. In the case of GLV-1h74, mice started to die on day 38 post-infection and most mice died within 48 days post-infection. In the GLV-1h68, GLV-1h70, GLV-1h72, and GLV-1h73 infections, the first deaths occurred sometime between day 38 and day 48, but the death curves were more gradual.

2. Post-Infection Body Weight

The percentage of body weight change following i.v. administration of the viruses was also examined and similarly found to vary significantly among the different vaccinia strains tested. GLV-1h74 again exhibited the most toxicity in mice with a 17% decrease in net body weight 37 days after intravenous delivery. GLV-1h22, GLV-1h71, and GLV-1h72 on the other hand, did not elicit any net body weight change in infected mice. GLV-1h68, GLV-1h70, and GLV-1h73 strains did exhibit net body weight changes in infected mice, though the effects were more gradual with decreases emerging only after 45 days following infection. At day 65 post-infection, mice exhibited decreases in body weight of approximately 6%, 6%, and 2.5% for GLV-1h68, GLV-1h70, and GLV-1h73 strains respectively.

C. Effects of GLV-1h73 on Body Weight of Mice that Do Not Bear Tumors

Groups of 6-week-old female BALB/c and C57BL/6 mice (7-8 mice per group) were mock-infected (with PBS) or infected via the tail vein with $5\times10^7$, $1\times10^8$ and $2\times10^8$ PFU of GLV-1h73. Mice were weighed every two days for 30 days and compared with weights on day 1 post infection. Over the course of the study, both BALB/c and C57BL/6 mice gained more weight at all doses tested than did the mock-infected mice, indicating no acute toxicity was caused by GLV-1h73 infection at the dose up to $2\times10^8$ PFU.

Example 5

Effect of an Antiviral Agent on Plaque Formation in Vitro

Administration of an antiviral agent to a subject to whom a virus is administered for tumor treatment can be used to reduce any toxic effects that the virus has on the subject. Therefore, the effect of the antiviral agent cidofovir on plaque formation by the recombinant vaccinia virus strains was assessed in vitro by infection of CV-1 cells. Four viruses were tested: GLV-1h68, GLV-1h71, GLV-1h73, and GLV-1h74. CV-1 cells were plated in 24-well plates and were infected with 30 PFU/well of each virus for 1 h at 37° C. The inoculum was then removed by aspiration, and 1 ml overlay medium was added per well containing a different concentration (in triplicate) of cidofovir (Visitide, Gilead Sciences, Inc.). The concentrations of cidofovir tested were 0.2, 0.5, 2, 5, 20 µg/ml. After incubation in a $CO_2$ incubator at 37° C. for 48 h, the cells were stained with crystal violet and plaque formation was assessed.

For all four strains tested, smaller plaques were formed at a concentration of 5 µg/ml cidofovir. Plaque formation by strains GLV-1h68 and GLV-1h71 was almost completely inhibited at 20 µg/ml cidofovir; only one tiny plaque for GLV-1h68 and 3 small plaques for GLV-1h71 were found. For strains GLV-1h73 and GLV-1h74, the number and size of plaques were significantly reduced at 20 µg/ml cidofovir, but not totally inhibited. For all four strains, no significant differences in size or number of plaques were seen when control (0

µg/ml cidofovir) experiments were compared to test experiments in which low levels of cidofovir (i.e., 0.2, 0.5, 2 µg/ml) were used.

Example 6

Effect of an Antiviral Agent on Ability of Modified Vaccinia Viruses to Arrest or Reverse in vivo Tumor Growth The in vivo effect of cidofovir on tumor growth inhibition by modified vaccinia virus strain GLV-1h74 was evaluated using a mouse model of breast cancer. Tumors were established in nude mice by subcutaneously (s.c.) injecting GI-101A human breast carcinoma cells into female nude mice (see Example 4). Eight mice were tested for each treatment. At 27 days after s.c. implantation, the mice were injected with $5 \times 10^6$ PFU of GLV-1h74 or PBS. Twelve days after virus injection, 0 or three different doses (25, 50, or 100 mg/kg, i.p. route) of cidofovir were injected. All three doses of cidofovir treatment significantly extended the survival time of GLV-1h74 injected mice, indicating attenuation of the viral toxicity by the cidofovir. The 50 mg/kg dose appeared to work a slightly better than the lower 25 mg/kg dose or higher 100 mg/kg dose. The treatment with cidofovir did not significantly interfere with tumor therapy by the virus (Table 14). The median tumor volume of the mice treated with virus plus cidofovir was comparable to treatment with virus alone in reversing tumor growth.

TABLE 14

| Days post-GI-101A tumor cell implantation | Untreated control | GLV-1h74 alone | GLV-1h74 + cidofovir 25 mg/kg | GLV-1h74 + cidofovir 50 mg/kg | GLV-1h74 + cidofovir 100 mg/kg |
| --- | --- | --- | --- | --- | --- |
| 32 | 204.3 | 264.9 | 291.1 | 279.8 | 587.1 |
| 42 | 333.9 | 365.7 | 314.2 | 359.5 | 391.1 |
| 50 | 646.6 | 155.3 | 238.3 | 206.5 | 184.0 |
| 56 | 886.4 (8)* | 62.0 (2)* | 117.4 (6)* | 61.0 (8)* | 58.9 (6)* |

*Number of mice surviving at 56 days post tumor cell implantation

Example 7

Comparison of the Effects on Mouse Body Weight and Survival of Vaccinia Viruses that do not Contain a Functional Thymidine Kinase-Encoding Gene A. RVGL2 Vaccinia Strain The toxicity of a modified vaccinia strain, RVGL2, containing an insertion of two expression cassettes into the thymidine kinase (TK) gene of strain LIVP was examined in several different mouse tumor models. Modified vaccinia virus strain RVGL2 was recombinantly engineered from vaccinia virus LIVP strain (SEQ ID NO: 2). Methods for the construction of RVGL2 can be found in U.S. Patent Publication No. 2005/0031643 (see Example 1 of U.S. Patent Publication No. 2005/0031643). RVGL2 contains two marker gene expression cassettes, Ruc-GFP under the control of vaccinia early/late promoter $P_{E/L}$ and lacZ under the vaccinia early promoter $P_{7.5k}$, inserted into the TK gene coding sequence. For purposes of comparison, the effects of VV strains WR and LIVP on body weight and survival also were examined in the same mouse tumor models. Strain WR (ATCC, Manassas, Va.) contains a functional TK gene. Strain LIVP contains a mutation in the TK gene that interrupts the coding sequence and therefore does not encode a functional thymidine kinase protein.

1. Animal Tumor Models

Athymic nude mice (nu/nu) and C57BL/6 mice (Harlan Animal Res., Inc., Wilmington, Mass.) at 6-8 weeks of age were used for animal studies.

a. Glioma Model

To establish subcutaneous glioma tumor, rat glioma C6 cells (ATCC No. CCL-107) were collected by trypsinization, and $5 \times 10^5$ cells/0.1 ml/mouse were injected subcutaneously (s.c.) into right hind leg of 6-8 week old male athymic mice. On day 7 after C6 cell implantation when median tumor size was about 150 mm$^3$, viruses at the dose of $10^7$ PFU/0.1 ml/mouse were injected intravenously (i.v.) into the femoral vein. Mice were sacrificed 14 days after virus injection.

b. Breast Tumor Model

To develop subcutaneous (s.c) breast tumors in mice, human breast cancer GI-101A cells (Rumbaugh-Goodwin Institute for Cancer Research Inc. Plantation, Fla.; U.S. Pat. No. 5,693,533) at the dose of $5 \times 10^6$ cells/0.1 ml/mouse were injected s.c. into the right hind leg of 6-8 week old female athymic mice. On day 30 after GI-10A cell implantation, when median tumor size was about 500 mm$^3$, viruses at the dose of $10^7$ PFU/mouse were injected i.v. into the femoral vein. Mice were sacrificed on day 14 after virus injection. Mice for survival experiments and breast tumor therapy studies were kept for long time periods (more than 100 days after virus injection). Mice that developed tumors that were about 4000 mm$^3$ in size and/or lost 50% of body weight were sacrificed.

c. Melanoma Model

For a melanoma model, mouse melanoma B16-F10 cells (ATCC No. CRL-6475) at the dose of $2 \times 10^5$ cells/0.04 ml/mouse were injected into the foot pad of 6-8 week old male C57BL/6 mice. When the tumor was established (median size of tumor about 100 mm$^3$), on day 18 after cell implantation, viruses at the dose of $10^7$ PFU/mouse were injected i.v. into the femoral vein. Mice were sacrificed 10 days after virus injection.

2. Injection of Virus into Animal Tumor Models

VV strains WR, L1VP, and RVGL2, were individually injected i.v. at a single dose of $1 \times 10^7$ PFU in 100 µl PBS into mice with C6 tumors (7 days after implantation of tumor cells), GI-101A tumors (30 days after implantation of tumor cells), or B16-F10 tumors (18 days after implantation of tumor cells). Body weight was monitored thereafter twice a week. Change of body weight was calculated as follows: ((b'−t')−(b−t))/(b−t), where b and t are the body weight and tumor weight on day of virus injection, and b' and t' are the corresponding weights on the day of monitoring (n=4). For measurement of survival rate, tumorous mice were i.v. injected with individual VV strains at a single dose of $1 \times 10^7$ PFU/mouse at 30 days after tumor cell implantation and survival was recorded over a 30 to 120-day period, depending on the tumor model.

3. Results

RVGL2 is markedly attenuated and showed significantly lower toxicity in the mouse tumor models. The survival rate of mice injected with RVGL2 is significantly longer than mice injected with wild type LIVP or WR. The difference in survival of the mice treated with RVGL2 was statistically significant compared with those treated with LIVP or WR (p<0.0001) (n>5). Mice infected with the WR and LIVP strains started to die around day 8 or day 20, respectively, after virus infection with no mice surviving past 12 days or 35 days, respectively, after infection. The WR and LIVP infected mice also exhibited weight losses ranging from 15-35% 10 days after infection for WR and 5-35% 14 days after infection for LIVP. Mice injected with RVGL2 strain exhibited no weight changes for the duration of the experiment (up to 14 days after infection) and the death curve was more gradual with 100% of the mice surviving up to day 80, 70% up to day 105 and 20% at day 120.

The TK gene in the wild-type LIVP is known to be mutated, and no functional TK protein is expressed in the infected cells as confirmed through a BrdU assay using standard techniques well-known in the art. Because strain RVGL2 is much more attenuated than strain LIVP, yet neither strain encodes a functional TK protein, the attenuation effect is, therefore, not due to loss of TK gene function. The marker proteins, LacZ and Ruc-GFP, contained in the TK locus of RVGL2 also are not known to have any virus attenuation or tumor therapy function; though the introduction of the expression cassettes into the TK gene markedly attenuated the virus.

Example 8

Effects of Route of Administration on In Vivo Models of Anti-Tumor Therapy

The in vivo effects of vaccinia virus on tumor growth using different routes of administration were assessed using the GI-101A mouse breast cancer model. The vaccinia virus strain GLV-1h73 was used for the comparison. Human breast cancer GI-101A cells at the dose of $5 \times 10^6$ cells/0.1 ml/mouse were injected s.c. into the right hind leg of 6-8 week old female athymic mice. On day 27 after GI-101A cell implantation, viruses at the dose of $5 \times 10^6$ PFU/mouse were injected using four different injection methods: intratumoral injection, intravenous tail vein injection, intravenous femoral vein injection, and intraperitoneal injection. Median tumor volume was measured at various time points following tumor cell implantation (Table 15).

Following both venous administrations of the virus, the mice exhibited an initial increase in tumor growth (approximately 3.5-4.5 times the tumor size compared to day of virus injection) followed by a rapid shrinkage of the tumor after 13 days post virus injection with tail vein administration (40 days post tumor cell implantation in Table 15), and 21 days post virus injection with femoral vein administration (48 days post tumor cell implantation in Table 15). Tumor eradication was achieved at approximately 30 days and 50-60 days post virus administration for the tail vein and femoral vein injections, respectively. For the intratumoral injection of the virus, the mice exhibit less of an initial tumor growth (approximately 2 times the tumor size compared to day of virus injection); however the eradication of the tumor was much slower than that observed with intravenous administrations: 80 days compared to 30 or 50-60 days. It also was observed that the toxicity of GLV-1h73 when injected into the mice intravenously was higher than the intratumoral injection. Intraperitoneal injection of the virus was unable to reverse tumor growth. Taken together, the data suggest that intravenous injection is a more potent route of administration for eradication of tumors, although the toxicity of the virus is higher.

TABLE 15

Median tumor volume at different times following injection of GLV-1h68 via different routes in mice bearing GI-101A tumors

| Days post-GI-101A tumor cell implantation | Median tumor volume (mm$^3$) | | | |
|---|---|---|---|---|
| | Intratumoral | Intravenous Tail Vein | Intravenous Femoral Vein | Intraperitoneal |
| 27 | 215.2 | 388.6 | 285.6 | 286.1 |
| 33 | 626.9 | 972.8 | 616.9 | 543.5 |
| 40 | 731.6 | 1304.3 | 1141.0 | 880.5 |
| 48 | 644.5 | 650.9 | 1379.9 | 1395.4 |
| 56 | 509.6 | 151.6 | 813.8 | 1970.0 |
| 63 | 477.5 | 94.5 | 609.1 | 2708.2 |
| 69 | 436.9 | 74.4 | 280.4 | 2867.2 |
| 83 | 264.9 | * | * | 3391.5 |
| 90 | 261.6 | * | * | 3351.4 |
| 104 | 118.3 | * | * | 3603.6 |

*No median tumor volume was calculated due to the death of significant numbers or all of mice.

Example 9

Effect of Combination Therapy with Cisplatin on Ovarian Tumor Growth

The therapeutic effect of an attenuated vaccinia virus alone, or in combination with cisplatin, on the progression of human ovarian tumors was evaluated in a mouse model of human ovarian cancer. The therapeutic effect on tumor growth was determined by measuring the volume of an established tumor at various time points following administration of vaccinia virus.

A. Effect of GLV-1h68 on Human Ovarian Tumors

Tumors were established in nude mice by subcutaneously injecting $5 \times 10^6$ OVCAR-3 human ovarian carcinoma cells on the right lateral thigh (NIH: OVCAR-3, ATCC No. HTB-161) into female nude mice (Hsd:Athymic Nude-Foxn1$^{nu}$; Harlan, Indianapolis, Ind.). Four mice were tested in each group. Following tumor cell implantation, one group of mice was injected with $1 \times 10^7$ PFU/mouse of GLV-1h68 virus in the femoral vein at 54 days post-cancer cell injection, whereas the control group was injected with phosphate buffered saline (PBS). Tumor volume (mm$^3$) was measured at day 53, day 63, day 69 and day 77. Four tumors were tested at each time point. Results are provided in Table 16.

TABLE 16

| Days Post-implantation | Median tumor volume (mm$^3$) | |
|---|---|---|
| | GLV-1h68 | Control |
| 0 | 0.1 | 0.1 |
| 53 | 176.9 | 278.1 |
| 63 | 598.8 | 755 |
| 69 | 668.4 | 1169.9 |
| 77 | 896.6 | 2512.7 |

Administration of GLV-1h68 virus was able to slow tumor growth, but was not able to arrest growth of the OVCAR-3 tumors.

B. Effect of Combination Therapy, GLV-1h68 Plus Cisplatin, on Human Ovarian Tumors Tumors were established in nude mice by subcutaneously injecting 5×10⁶ OVCAR-3 human ovarian carcinoma cells on the right lateral thigh (NIH: OVCAR-3, ATCC No. HTB-161) into female nude mice [Hsd: Athymic Nude-Foxn1$^{nu}$; Harlan, Indianapolis, Ind.). Six to eight mice were tested in each group. Following tumor cell implantation, one group of mice was injected with 2×10⁶ PFUs of GLV-1h68 virus in the tail vein at 31 days post-cancer cell injection; one group of mice was intraperitoneally injected with 5 mg/kg cisplatin once a day on days 51, 52, 54 and 55 post-cancer injection; one group received combination therapy of GLV-1h68 and cisplatin, and the control group of mice was not given any treatment. Tumor volume (mm³) was measured at days 41, 55, 64, 71, 79, 87, 93, 99, 106, 113, and 119 post-cancer cell injection. Results are provided in Table 17.

TABLE 17

Median tumor volume (mm3) following treatment

| Days Post-implantation | GLV-1h68 alone (n = 7) | Cisplatin alone (n = 8) | GLV-1h68 + cisplatin (n = 6) | No treatment (n = 8) |
| --- | --- | --- | --- | --- |
| 41  | 298.8  | 479.5  | 415.1  | 348.2  |
| 55  | 1448.3 | 1748.5 | 1403.1 | 1972.7 |
| 64  | 2512.4 | 1553.3 | 1163.7 | 4969.5 |
| 71  | 3407.4 | 1297.0 | 993.0  | *      |
| 79  | *      | 2280.4 | 757.5  | *      |
| .87 | *      | 4108.8 | 667.0  | *      |
| 93  | *      | *      | 547.0  | *      |
| 99  | *      | *      | 549.0  | *      |
| 106 | *      | *      | 511.5  | *      |
| 113 | *      | *      | 465.3  | *      |
| 119 | *      | *      | 441.3  | *      |

* No median tumor volume was calculated due to the death of significant numbers or all of mice.

Treatment with GLV-1h68 virus alone decreased tumor growth rate, but did not shrink the tumors. Tumors treated with GLV-1h68 virus alone were partially filled with pus and were purplish in color in some areas of the tumor surface compared to untreated animals that are full of pus and purplish in color overall on the surface. Treatment with cisplatin alone initially reversed tumor growth, but two weeks after discontinued treatment, the tumors began growing again exponentially. Tumors treated with cisplatin alone are similar in appearance to non-treated mice and are full of pus and purplish in color. In the presence of both GLV-1h68 virus and cisplatin, tumor shrinkage was sustained until the end-point of the experiment (i.e., 119 days post-injection of cancer cells). Tumors treated with the combination therapy were solid (with no pus) and whitish in color, a phenotype characteristic of dying tumors that undergo significant shrinkage. Thus, the combination therapy was most effective in controlling and inhibiting ovarian tumor progression.

C. Effect of Combination Therapy, GLV-1h68 Plus Carboplatin, on Human Ovarian Tumors Tumors were established in nude mice by subcutaneously injecting 5×10⁶ OVCAR-3 human ovarian carcinoma cells on the right lateral thigh (NIH: OVCAR-3, ATCC No. HTB-161) into female nude mice [Hsd: Athymic Nude-Foxn1$^{nu}$; Harlan, Indianapolis, Ind.). Six to eight mice were tested in each group. Following tumor cell implantation, one group of mice was injected with 5×10⁶ PFUs of GLV-1h68 virus in the femoral vein at 56 days post-cancer cell injection; one group of mice was intraperitoneally injected with 32.5 mg/kg carboplatin in 200 μPBS on day 63, 66, 69, 72, 75, 78, 81 and day 84 post-cancer cell injection for a total of 8 doses; one group received combination therapy of GLV-1h68 and cisplatin; and the control group of mice was not given any treatment. Tumor volume (mm³) was measured at days 55, 62, 70, 75, 81, 89 and 96 post-cancer cell injection. Results are provided in Table 17a.

TABLE 17a

Median tumor volume (mm³) following treatment

| Days Post-implantation | GLV-1h68 alone | Carboplatin alone | GLV-1h68 + cisplatin | No treatment |
| --- | --- | --- | --- | --- |
| 55 | 268.4   | 676.45  | 402.1   | 793.45  |
| 62 | 623.7   | 1565.85 | 1128.15 | 1778.25 |
| 70 | 1232.5  | 5708.9  | 1485.05 | 3261.4  |
| 75 | 1277.05 | 3119.65 | 1599.35 | 4649.5  |
| 81 | 1189.55 | 3733.95 | 1411.4  | 7198.7  |
| 89 | 774.4   | 4109.75 | 1040.15 | *       |
| 96 |         | 4460.5  | 906.75  | *       |

Treatment with GLV-1h68 virus alone or combination therapy with GLV-1h68 virus and cisplatin appeared effective in slowing the initial tumor growth rate and then shrinking the tumor. Tumor shrinkage in mice treated with either regimen was sustained until the end-point of the experiment. While monotherapy with cisplatin reduced the rate of tumor growth, compared to untreated mice, the treatment was not able to reduce the size of the tumors or arrest growth completely.

Example 10

Comparison of Two Chemotherapeutic Agents in Combination Therapy Against Human Breast Carcinoma Tumors In Vivo The therapeutic effect of an attenuated vaccinia virus alone, or in combination with either cisplatin or doxorubicin, on the progression of human breast carcinoma tumors was evaluated in a direct in vivo study.

Tumors were established in nude mice by subcutaneously injecting 5×10⁶ cells GI-101A human breast carcinoma cells (Rumbaugh-Goodwin Institute for Cancer Research Inc. Plantation, Fla.; U.S. Pat. No. 5,693,533] subcutaneously on the right lateral thigh of female nude mice (Hsd:Athymic Nude-Foxn1$^{nu}$; Harlan, Indianapolis, Ind.; n=4-8 mice/group). Following tumor cell implantation, one group of mice was injected with 1×10⁶ PFU/mouse of GLV-1h68 virus in the tail vein at 32 days post-cancer cell injection, one group of mice was intraperitoneally injected with 5 mg/kg cisplatin once daily on each of days 47, 48, 49, 50 and 51 post-cancer cell injection, one group received combination therapy of GLV-1h68 and cisplatin, one group of mice was intraperitoneally injected with 3 mg/kg doxorubicin (Sigma Catalog no. 44583) alone once a week for 4 consecutive weeks starting 47 days post-cancer cell injection, one group of mice received combination therapy of GLV-1h68 and doxorubicin, and the control group of mice was not given any treatment. Tumor volume (mm³) was measured at days 32, 47, 52, 56, 63, 67, 76, 80, 89, 96 and 104 post-cancer cell injection. Results are provided in Table 18.

TABLE 18

Median tumor volume (mm3) on days post-GI-101A injection

| Days Post-implantation | GLV-1h68 alone (n = 7) | Cisplatin alone (n = 5) | GLV-1h68 + cisplatin (n = 6) | Doxorubicin alone (n = 5) | GLV-1h68 + doxorubicin (n = 4) | No treatment (n = 8) |
|---|---|---|---|---|---|---|
| 32 | 212.7 | 208.9 | 184.4 | 192.4 | 155.2 | 171.5 |
| 47 | 694.0 | 646.0 | 538.8 | 664.0 | 496.9 | 463.1 |
| 52 | 810.7 | 622.1 | 582.4 | 856.6 | 558.0 | 561.3 |
| 56 | 901.7 | 637.7 | 570.1 | 968.2 | 599.1 | 667.9 |
| 63 | 1096.2 | 865.1 | 893.1 | 1328.6 | 850.5 | 1066.3 |
| 67 | 990.6 | 963.1 | 916.4 | 1390.2 | 1066.6 | 1105.7 |
| 76 | 914.3 | 1260.6 | 772.7 | 1884.1 | 1296.7 | 1420.9 |
| 80 | 903.1 | 1484.3 | 692.4 | 2213.1 | 1308.9 | 1959.9 |
| 89 | 801.5 | 2171.9 | 669.2 | 2484.8 | 1457.1 | 2948.1 |
| 96 | 644.4 | 2996.1 | 446.6 | * | 1357.6 | 3453.9 |
| 104 | 525.9 | 2849.4 | 454.1 | * | 1339.8 | 4202.5 |

* No median tumor volume was calculated due to the death of significant numbers or all of mice.

In contrast to the OVCAR-3 human ovarian carcinomas, treatment of GI-101A human breast carcinomas with GLV-1h68 alone resulted in tumor shrinkage. Treatment with cisplatin alone decreased the rate of tumor growth, but did not shrink tumors. Treatment with doxorubicin alone did not have any effect on the rate of tumor growth and results were similar to the untreated control animals. Treatment of animals with a combination of doxorubicin and GLV-1h68 was more effective than the untreated control animals, but was not as effective as GLV-1h68 treatment alone, thus, doxorubicin may inhibit viral oncolytic activity. Treatment of animals with a combination of cisplatin and GLV-1h68 had the greatest effect on the shrinkage of the tumors and exhibited phenotypes characteristic of dying tumors as described above.

Example 11

Effect of Combination Therapy with Cisplatin on Human Pancreatic Tumors

The therapeutic effect of a modified vaccinia virus alone, or in combination with cisplatin, on the progression of human pancreatic tumors was evaluated in a direct in vivo study of a mouse model of human pancreatic cancer. The therapeutic effect on tumor growth was determined by measuring the volume of the tumor at various time points.

A. Effect of GLV-1h68 or Cisplatin on Human Pancreatic Tumors

Tumors were established in nude mice by subcutaneously injecting 5×10$^6$ cells PANC-1 human pancreatic carcinoma cells (ATCC No. CRL-1469) subcutaneously on right lateral thigh of male nude mice (Hsd:Athymic Nude-Foxn1$^{nu}$; Harlan, Indianapolis, Ind.; n=3-8 mice/group). Following tumor cell implantation, one group of mice was injected with 2×10$^6$ PFU/mouse of GLV-1h68 virus in the tail vein 37 days post-cancer cell injection, one group of mice was intraperitoneally injected with 5 mg/kg cisplatin on each of days 46, 47, 48, 49 and 50 post-cancer cell injection, and the control group of mice was not given any treatment. Tumor volume (mm$^3$) was measured at days 36, 46, 52, 57, 63, 72, 79, 86, 94 and 100 post-cancer cell injection. Results are provided in Table 19.

TABLE 19

| | Median tumor volume (mm$^3$) | | |
|---|---|---|---|
| Days Post-implantation | No treatment (n = 6) | GLV-1h68 (n = 8) | Cisplatin (n = 3) |
| 36 | 196.2 | 153.1 | 170.2 |
| 46 | 300.9 | 351.8 | 296.6 |
| 52 | 400.8 | 385.3 | 254.95 |
| 57 | 540.2 | 396.3 | 326.2 |
| 63 | 721.4 | 247.7 | 460.3 |
| 72 | 1082.5 | 156.8 | 663.4 |
| 79 | 1640.3 | 128.4 | 1022.0 |
| 86 | 2599.8 | 64.5 | 1718.3 |
| 94 | 3927.9 | 56.6 | 2520.4 |
| 100 | 4556.7 | 39.5 | 3254.1 |

Although cisplatin slowed the growth rate of the pancreatic tumor significantly compared to untreated controls, it was unable to arrest tumor growth. GLV-1h68, on the other hand, caused shrinkage of the pancreatic tumors as early as 29 days after virus injection.

B. Effect of Combination Therapy, GLV-1h68 with Cisplatin, on PANC-1 Human Pancreatic Tumors Tumors were established in nude mice by subcutaneously injecting 5×10$^6$ cells PANC-1 human pancreatic carcinoma cells (ATCC# CRL-1469) subcutaneously on right lateral thigh of male nude mice (n=8-11 mice/group). Following tumor cell implantation, one group of mice was injected with 1×10$^6$ PFU/mouse of GLV-1h68 (RVGL21) virus in the tail vein 32 days post-cancer cell injection, one group of mice was treated with a combination of GLV-1h68 (1×10$^6$ PFU/mouse of GLV-1h68 injected in the tail vein at day 32) and intraperitoneal injection of 6 mg/kg cisplatin once daily on each of days 42, 43, 44, 45 and 46), one group received cisplatin only, and the control group received no treatment. Tumor volume (mm$^3$) in mice administered GLV-1h68 or GLV1h68 and cisplatin was measured at days 31, 46, 52, 59, 68, 75, 84, 90 and 96 post-cancer cell injection. Tumor volume (mm$^3$) in the control group and mice administered cisplatin only was measured at days 36, 46, 52, 57, 63, 72 and 79 days post-cancer cell injection. Results are provided in Table 20.

TABLE 20

Median tumor volume at different times following treatment with
GLV-1h68 and cisplatin in mice bearing PANC-1 tumors

| | Median tumor volume (mm$^3$) | | | |
|---|---|---|---|---|
| Days Post-implantation | GLV-1h68 (n = 11) | GLV-1h68 + Cisplatin (n = 8) | Cisplatin | No treatment |
| 31 (36) | 118.9 | 125.8 | 170.2 | 196.15 |
| 46 (46) | 282.6 | 365.6 | 296.6 | 300.9 |
| 52 (52) | 315.9 | 206.5 | 254.95 | 400.8 |
| 59 (57) | 291.6 | 325.4 | 326.2 | 540.2 |
| 68 (63) | 290.5 | 250.8 | 460.3 | 721.35 |
| 75 (72) | 209.5 | 122.0 | 663.4 | 1082.45 |
| 84 (79) | 196.8 | 70.7 | 1022 | |
| 90 | 119.9 | 51.9 | | |
| 96 | 133.5 | 0 | | |

Tumor shrinkage was more pronounced with the combination therapy of GLV-1h68 in combination with cisplatin compared to GLV-1h68 alone. Tumors were resolved with the combination therapy on day 64 post-virus injection.

C. Effect of Combination Therapy, GLV-1h68 with Cisplatin, on MIA-PaCa2 Human Pancreatic Tumors The effect of combination treatment with GLV-1h68 and cisplatin was evaluated using a second mouse model of human pancreatic cancer. Tumors were established in nude mice by subcutaneously injecting 5×10$^6$ cells MIA PaCa-2 human pancreatic carcinoma cells (ATCC No. CRL-1420) subcutaneously on right lateral thigh of male nude mice (Hsd: Athymic Nude-Foxn nU; Harlan, Indianapolis, Ind.; n=3-8 mice/group). Thirty-one days following tumor cell implantation, mice in on group were injected intravenously [in 100 μl of PBS, through femoral vein under anesthesia] with 5×10$^6$ PFU of GLV-1h68, followed by intraperitoneal injection of 4 mg/kg cisplatin on day 42, 43, 44, 45 and 46; mice in another group were injected intravenously with 5×10$^6$ PFU of GLV-1h68; mice in a further group were injected intraperitoneally with 4 mg/kg cisplatin on day 42, 43, 44, 45 and 46; and mice in the control group received no treatment. Tumor volume (mm$^3$) was measured at 31, 42, 48, 56, 64 and 70 days post-cancer cell injection. Results of median tumor volume (mm$^3$) are provided in Table 20a.

Combination therapy of GLV-1h68 in combination with cisplatin and virotherapy with GLV-1h68 alone effectively controlled tumor growth compared to monotherapy with cisplatin or no treatment. Combination therapy of GLV-1h68 in combination with cisplatin and virotherapy with GLV-1h68 alone appeared equally effective at shrinking and controlling MIA-PaCa2 tumors in nude mice.

TABLE 20a

Median tumor volume at different times following treatment with GLV-1h68 and cisplatin in mice bearing MIA-PaCa2 tumors

| | Median tumor volume (mm$^3$) | | | |
|---|---|---|---|---|
| Days Post-implantation | No treatment | GLV-1h68 | cisplatin | GLV-1h68 + cisplatin |
| 31 | 681.45 | 537.9 | 577.7 | 674.9 |
| 42 | 3295.05 | 2110.9 | 2991.25 | 2195.8 |
| 48 | 4164.3 | 1916.1 | 5171.9 | 1741.75 |
| 56 | 5586.1 | 1462 | 8454.65 | 1623.35 |
| 64 | * | 1191 | * | 1321.85 |
| 70 | * | 1200.3 | * | 1130.35 |

Example 12

Effect of Combination Therapy with Gemcitabine on Human Tumors

The therapeutic effect of a modified vaccinia virus alone, or in combination with gemcitabine, on the progression of human lung tumors and human pancreatic tumors was evaluated in vivo mouse tumor models.

A. Effect of Combination Therapy, GLV-1h68 with Gemcitabine, on Human Lung Carcinoma Tumors The therapeutic effect of a modified vaccinia virus alone, or in combination with gemcitabine, on tumor growth inhibition was evaluated in a direct in vivo study in a mouse model of human lung cancer. The therapeutic effect on tumor growth was determined by observing phenotypic changes in the tumors and by measuring the volume of the tumor at various time points.

Tumors were established by subcutaneously injecting A549 human lung carcinoma cells [s.c. on right lateral thigh; 5×10$^6$ cells; ATCC# CCL-185] into male nude mice [Hsd: Athymic Nude-Foxn1$^{nu}$; Harlan, Indianapolis, Ind.] (n=4-8). On day 23 after A549 cell implantation, viruses at a dose of 5.0×10$^6$ PFU/mouse were injected intravenously (i.v.) into the femoral vein. At 7, 10, 13, 16 and 19 days after virus injection, Gemcitabine (Gemzar®, Eli Lilly and Company, at 50 mg/kg or 100 mg/kg) was injected intraperitoneally (i.p.). Median tumor volume (mm$^3$) was measured at 22, 30, 37, 44, 51, 58, and 65 days post-tumor cell implantation. Results are provided in Table 21a.

Gemcitabine alone actually increased tumor growth in the mice at both 50 mg/kg and 100 mg/kg doses. In contrast, gemcitabine enhanced the slowing of tumor growth and tumor shrinkage of GLV-1h68 when administered in the combination with GLV-1h68 at earlier time points following administration of the virus (compare e.g., day 37 post-tumor cell implantation onward). Combination therapy with the lower dosage (50 mg/kg) of gemcitabine promoted a more rapid response of tumor shrinkage as compared to the higher dosage or GLV-1h68 alone.

TABLE 21a

Effect of Gemcitabine Combination Therapy on Human Lung Tumors

| | Median tumor volume (mm$^3$) | | | | | |
|---|---|---|---|---|---|---|
| Days Post-implantation | No treatment | GLV-1h68 | Gemcitabine 50 mg/kg | GLV-1h68 + Gemcitabine 50 mg/kg | Gemcitabine 100 mg/kg | GLV-1h68 + Gemcitabine 100 mg/kg |
| 22 | 226.5 | 303.8 | 245.6 | 234.0 | 228.1 | 251.9 |
| 30 | 477.4 | 677.2 | 579.8 | 565.7 | 487.4 | 599.1 |
| 37 | 557.1 | 1031.0 | 745.3 | 725.5 | 693.6 | 906.5 |

TABLE 21a-continued

Effect of Gemcitabine Combination Therapy on Human Lung Tumors

| | Median tumor volume (mm³) | | | | | |
|---|---|---|---|---|---|---|
| Days Post-implantation | No treatment | GLV-1h68 | Gemcitabine 50 mg/kg | GLV-1h68 + Gemcitabine 50 mg/kg | Gemcitabine 100 mg/kg | GLV-1h68 + Gemcitabine 100 mg/kg |
| 44 | 870.0 | 885.7 | 1023.9 | 544.4 | 1046.0 | 796.8 |
| 51 | 1442.7 | 902.0 | 1229.7 | 485.6 | 1580.2 | 616.3 |
| 58 | 1520.4 | 456.8 | 1619.0 | 336.9 | 2216.6 | 444.9 |
| 65 | 2168.7 | 262.1 | 2852.0 | 393.5 | 3413.4 | 424.1 |

B. Effect of Combination Therapy, GLV-1h68 with Gemcitabine, on Human Pancreatic Tumors The therapeutic effect of a modified vaccinia virus alone, or in combination with gemcitabine, on tumor growth inhibition was evaluated in a direct in vivo study in a mouse model of human pancreatic cancer. The therapeutic effect on tumor growth was determined by observing phenotypic changes in the tumors and by measuring the volume of the tumor at various time points.

Tumors were established by subcutaneously injecting PANC-1 human pancreatic carcinoma cells [s.c. on right lateral thigh; 5×10⁶ cells; ATCC# CRL-1469] into male nude mice [Hsd:Athymic Nude-Foxn1$^{nu}$; Harlan, Indianapolis, Ind.] (n=3-8 mice/group). On day 28 after PANC-1 cell implantation, viruses at a dose of 5.0×10⁶ PFU/mouse were injected intravenously (i.v.) into the tail vein. At 7, 10, 13, 16 and 19 days after virus injection, Gemcitabine (Gemzar®, Eli Lilly and Company, at 50 mg/kg or 100 mg/kg) was injected intraperitoneally (i.p.). Median tumor volume (mm³) was measured at 28, 35, 42, 50, 56, 63, 71 and 79 days post-tumor cell implantation. Results are provided in Table 21b.

Gemcitabine alone moderately decreased tumor growth in the mice at both 50 mg/kg and 100 mg/kg. In combination with GLV-1h68, gemcitabine enhanced the slowing of tumor growth and promoted tumor shrinkage by GLV-1h68 (compare e.g., day 42 post-tumor cell implantation onward). Combination therapy with the lower dosage (50 mg/kg) of gemcitabine promoted a more rapid response of tumor shrinkage as compared to the higher dosage or GLV-1h68 alone.

Example 13

Effect of Vaccinia Virus Expression of Human Plasminogen k5 Domain on Human Lung Carcinoma Tumors The therapeutic effect of administration vaccinia viruses expressing an angiogenesis inhibitor on the progression of A549 tumors was evaluated in a direct in vivo study in a mouse model of human lung cancer. GLV-1h81, which expresses human plasminogen k5 domain, and the GLV-1h68 control strain were used for the study. The therapeutic effect on tumor growth was determined by observing phenotypic changes in the tumors and by measuring the volume of the tumor at various time points.

Tumors were established by subcutaneously injecting A549 human lung carcinoma cells [s.c. on right lateral thigh; 5×10⁶ cells; ATCC# CCL-185] into male nude mice [Hsd:Athymic Nude-Foxn1$^{nu}$; Harlan, Indianapolis, Ind.] (n=4-8). On day 23 after A549 cell implantation, viruses at a dose of 5.0×10⁶ PFU/mouse were injected i.v. into the femoral vein. Median tumor volume (mm³) was measured at 22, 30, 37, 44, 51, 58, and 65 days post-tumor cell implantation. Results are provided in Table 22. In the mouse model for human lung carcinoma, GLV-1h81, which expresses, human plasminogen k5 domain, was able to slow tumor growth though the effect was less pronounced than the GLV-1h68 strain. The difference in therapeutic effect may be due to an attenuating effect of the strong synthetic early/late promoter on the GLV-1h81 virus.

TABLE 21b

Effect of Gemcitabine Combination Therapy on Human Pancreatic Tumors

| | Median tumor volume (mm³) | | | | | |
|---|---|---|---|---|---|---|
| Days Post-implantation | No treatment | GLV-1h68 | Gemcitabine 50 mg/kg | GLV-1h68 + Gemcitabine 50 mg/kg | Gemcitabine 100 mg/kg | GLV-1h68 + Gemcitabine 100 mg/kg |
| 28 | 281.6 | 231.7 | 268.0 | 226.2 | 209.7 | 227.8 |
| 35 | 395.4 | 425.9 | 359.2 | 408.6 | 417.8 | 401.3 |
| 42 | 616.7 | 724.5 | 543.6 | 592.3 | 652.5 | 662.5 |
| 50 | 1114.6 | 845.1 | 584.8 | 513.2 | 810.3 | 569.7 |
| 56 | 1146.5 | 776.3 | 682.9 | 510.1 | 655.6 | 554.1 |
| 63 | 1446.1 | 547.9 | 654.7 | 372.5 | 407.3 | 508.8 |
| 71 | 2074.6 | 376.3 | 1006.2 | 257.9 | 789.1 | 281.6 |
| 79 | 2907.7 | 268.2 | 1534.1 | 257.7 | 1437.0 | 242.4 |

TABLE 22

| Days Post-implantation | Median tumor volume (mm³) | | |
|---|---|---|---|
| | No treatment | GLV-1h68 | GLV-1h81 |
| 22 | 226.5 | 303.8 | 290.9 |
| 30 | 477.4 | 677.2 | 651.2 |
| 37 | 557.1 | 1031.0 | 955.6 |
| 44 | 870.0 | 885.7 | 1087.7 |
| 51 | 1442.7 | 902.0 | 1068.5 |
| 58 | 1520.4 | 456.8 | 756.0 |
| 65 | 2168.7 | 262.1 | 685.9 |

Example 14

Imaging of Viruses Expressing Multiple Proteins for Detection

Recombinant vaccinia viruses that express click beetle luciferase-mRFP1 (CBG99-mRFP1) and *Renilla* luciferase-GFP (Ruc-GFP) fusion genes were generated as described above to facilitate evaluation of virus replication in vitro and monitoring virus therapeutic effects and spread in vivo. GLV-1h84, which expresses CBG99-mRFP1, and GLV-1h86, which expresses Ruc-GFP, were used to evaluate the ability to monitor viruses in vitro and in vivo by fluorescence and bioluminescence imaging techniques. In the GLV-1h84 strain, CBG99 and mRFP1 are connected through a picornavirus 2A element. During translation, these two proteins are cleaved into two individual proteins at picornavirus 2A element. In the GLV-1h86 strain, Ruc-GFP is expressed as a fusion protein. As described in Example 1, the GLV-1h84 strain exhibits strong expression of mRFP1 as confirmed by fluorescence microscopy.

Real-time monitoring of infection was performed using CV-1 (green monkey kidney cells) and GI-101A (human breast adenocarcinoma) cells infected with GLV-1h84 and GLV-1h86. Infection of CV-1 and GI-101A cells with GLV-1h84 at an m.o.i. of 0.01 was monitored in real-time using fluorescence microscopy. In both cell types, individual red plaques were seen 24 hours post infection (hpi). By 48 hpi, more than 80% of cells were infected; at 72 hpi, almost all cells were infected. GLV-1h86 showed similar spreading patterns in both CV1 and GI-101A cells in comparison with GLV-1h84. Infection of both cell types with either GLV-1h84 or GLV-1h86 was also imaged by measuring luciferase activities.

In a separate experiment of in vitro infection of CV1 cells, luciferase assays of 0.5 mg cell extract were performed at different times post infection. GLV-1h68 Ruc-GFP infected CV1 cells were assayed with 0.0375 mg coelenterazine and GLV-1h84 CBG99-RFP infected CV1 cells with 0.5 mg beetle luciferin. Even though the click beetle luciferase was incubated with more luciferin, the photon emission during the assay was comparable for both luciferases. Data is shown in Table 23.

TABLE 23

| Time Hours Post-Infection | Relative Light Units | |
|---|---|---|
| | GLV1h68 Ruc-GFP | GLV-1h84 CBG99-RFP |
| 0 | 16 | 26 |
| 2 | 22 | 52 |
| 4 | 173 | 402 |
| 6 | 22295 | 19824 |
| 8 | 10874 | 11070 |
| 10 | 45550 | 52618 |
| 12 | 95445 | 109189 |
| 14 | 214488 | 235280 |
| 18 | 661022 | 778738 |
| 24 | 14595754 | 15082362 |
| 32 | 3095943 | 3436978 |
| 40 | 2047472 | 2265043 |
| 48 | 1641432 | 1720210 |

Real-time monitoring of co-infection of the two viruses was also performed using CV-1 and GI-101A cells infected with both GLV-1h84 and GLV-1h86. When CV-1 cells were co-infected with GLV-1h84 and GLV-1h86 at an m.o.i. of 0.01 for each virus, individual red or green plaques were seen at 24 hpi under a fluorescence microscope, confirming that each virus plaque was derived from a single virus particle. At 48 hpi, most cells were infected. At later hpi, some of infected cells were yellow, indicating that cells infected with one virus can also be infected later with another virus. By 72 hpi, most cells were co-infected. In contrast, when GI-101A cells were co-infected with both viruses, there were not many yellow cells even by the time of 72 hpi, suggesting that the virus does not spread very well to GI-101A cells already infected.

Flow cytometric analysis was also performed on CV-1 cells infected with either GLV-1h84 or GLV-1h86 viruses or a combination of the two viruses to determine the levels of fluorescent molecule expression as well as assess any interference in the replication of the viruses following dual infection of viruses. CV-1 cells were infected at a m.o.i. of 0.5 for the single virus strain infection and a m.o.i. of 0.25 for each virus for the mixed infection. No significant differences were seen between the VV strains in the replication efficiency of the viruses. Expression of GFP was detectable earlier than RFP. VV strains did not influence fluorescence expression on each other as can be seen from the comparison of expected fluorescent cells and GFP and RFP expressing cells in the mixed infection. Data for the percentage of fluorescent cells for each infection is presented in Table 24.

TABLE 24

| | Percentage of Fluorescent Cells | | | | | | |
|---|---|---|---|---|---|---|---|
| Hours Post Infection | GFP | RFP | GFP in mixed infection | RFP in mixed infection | GFP + RFP in mixed infection | Total fluorescence in mixed infection | Expected GFP + RFP in mixed infection |
| 0 | 0.07 | 0.07 | 0.07 | 0.07 | 0.07 | 0.07 | 0.000049 |
| 4 | 0.27 | 0.07 | 0.11 | 0.12 | 0.08 | 0.15 | 0.000132 |
| 8 | 3.29 | 0.12 | 2.68 | 0.10 | 0.06 | 2.72 | 0.002 |
| 12 | 18.38 | 9.88 | 12.23 | 4.09 | 1.80 | 14.52 | 0.500 |

TABLE 24-continued

| | | | Percentage of Fluorescent Cells | | | | |
|---|---|---|---|---|---|---|---|
| Hours Post Infection | GFP | RFP | GFP in mixed infection | RFP in mixed infection | GFP + RFP in mixed infection | Total fluorescence in mixed infection | Expected GFP + RFP in mixed infection |
| 24 | 56.01 | 56.37 | 42.32 | 42.87 | 22.02 | 63.17 | 18.142 |
| 48 | 88.12 | 97.6 | 60.26 | 75.02 | 43.00 | 92.28 | 45.207 |

In vivo imaging was also performed by infecting tumor bearing mice with CBG99-mRFP1 expressing viruses. C6(pLEIN) glioma tumor bearing nude mice were injected intravenously with $5 \times 10^6$ PFU of GLV-1h84 and imaged at 7 days post infection. Tumor and poxes on the tail were detected by fluorescence and bioluminescence imaging of mRFP1 and CBG99, respectively. In another experiment GI-101A tumor bearing nude mice were injected with GLV-1h84 CBG99-RFP or Ruc-GFP expressing virus and imaged at 7 days p.i. Luciferase activity indicating the presence of the virus was detected in vivo at the location of the tumor following injection of click beetle luciferin or coelenterazine into the mice and detection by low light imaging methods. Detection of fluorescence emission by either RFP or GFP was also detected in vivo in live mice as well as in excised tumors.

The results of these studies show that vaccinia virus replication in cultured cells and in living mice can be monitored by both fluorescence and bioluminescence imaging. In addition to their use as diagnostic tools, these strains can be used to investigate the role of the immune system and pathogen clearance in initial tumor colonization. The described VV strains are useful tools to investigate the influence of one Vaccinia infection followed by a second infection since they did not influence each other in their replication but were clearly distinguishable from each other due to their multicolor labeling. One virus expresses GFP and *Renilla* luciferase (Ruc) and can be detected by fluorescence imaging at emission wavelength 509 nm for GFP and by photon emission at 482 nm after adding coelenterazine for Ruc; the other VV expresses RFP and click beetle luciferase (CBG99) and can be detected by fluorescence imaging at emission wavelength 583 nm for RFP and by photon emission at 537 nm after adding beetle luciferin for CBG99. Hence, both viruses can be used independently in the same mouse for comparative low light imaging and high resolution in in vivo and ex vivo histology analysis.

Example 15

Resonance Imaging of Viruses Expressing Iron Binding Proteins

Expression of iron binding proteins can enhance the imaging properties of viruses for in vivo detection. Vaccinia viral strains expressing the iron binding proteins, such as a ferritin and a transferrin receptor were tested for the ability to be detected in vivo using magnetic resonance imaging (MRI). Three strains were tested (GLV-1h22, GLV-1h82, and GLV-1h83) and compared to a control strain (GLV-1h68) that does not express the iron binding proteins. GLV-1h22 expresses the transferrin receptor, GLV-1h82 expresses both the transferrin receptor and *E. coli* ferritin, and GLV-1h83 expresses *E. coli* ferritin.

Tumors were established in athymic nu−/nu− mice by subcutaneously injecting $5 \times 10^6$ cells GI-101A human breast carcinoma cells subcutaneously on the right lateral thigh of female nude mice. At 30 days post tumor cell implantation, mice were i.v. injected with different vaccinia virus strains or PBS control into the lateral tail vein. At 14 days later (44 days post tumor cell implantation), mice were perfused using 4% formaldehyde. Colonization of VV was confirmed by GFP expression in the tumor. Tumors were then excised and MRI was performed (Spin echo sequence TR: 1200 ms, TE: 35 ms, rat coil (UCSD) 7T GE small animal MRI scanner). The resulting pictures were analyzed and the mean grey level of each tumor was determined. The results for the grey levels are shown in Table 25. Expression of the ferritin or the transferrin receptor enhanced the MRI contrast in the tumor tissue compared to the uninfected and GLV-1h68 controls. The co-expression of ferritin with the transferrin receptor, however, did not increase the effect. Expression of ferritin alone appeared to have the greatest effect, which suggests that there may be an attenuating effect on gene expression when additional expression cassettes are added to the virus or an interference effect of expressing a human transferrin receptor in a mouse cell. Nonetheless the experiments establish that expression of iron binding proteins or iron transporters is useful for detection of tumors.

TABLE 25

| | Grey Level | Standard Deviation | Mean |
|---|---|---|---|
| PBS control (uninfected) | 111 | 33 | 108 |
| GLV-1h68 | 100 | 26 | 99 |
| GLV-1h22 (hTfR) | 85 | 25 | 83 |
| GLV-1h82 a (ftn, hTfR) | 85 | 25 | 85 |
| GLV-1h82 b (ftn, hTfR) | 83 | 28 | 81 |
| GLV-1h83 (ftn) | 74 | 30 | 73 |

Example 16

Effects of Modified Viruses on Lung Tumor Growth In Vivo

A. Effects of Viruses Administered to Male Nude Mice on Human Lung Tumors

Tumors were established by subcutaneously injecting A549 human lung carcinoma cells [s.c. on right lateral thigh; $5 \times 10^6$ cells; ATCC# CCL-185] into male nude mice [Hsd: Athymic Nude-Foxn1$^{nu}$; Harlan, Indianapolis, 1N] (n=4-8). On day 23 after A549 cell implantation, GLV-1h68, GLV-1h71, GLV-1h72 and GLV-1h73 viruses at a dose of $5 \times 10^6$ PFU/mouse were injected i.v. into the femoral vein. Median tumor volume (mm$^3$) was measured at time points post-tumor cell implantation.

All three strains GLV-1h68, GLV-1h72, and GLV-1h73 promoted rapid responses of tumor shrinkage. The tumor shrinkage response induced by GLV-1h72 and GLV-1h73 was slightly faster. Treatment with GLV-1h71 led to approximately 50% decrease in tumor growth, but did not result in complete reverse of tumor growth as seen in the treatment groups of other three viruses.

TABLE 26

Median tumor volumes at different time points after i.v. injection of different virus strains into nude mice bearing A549 tumors

| Days post-implantation of tumor cells | Median tumor volume (mm³) | | | | |
|---|---|---|---|---|---|
| | No Treatment | GLV-1h68 | GLV-1h71 | GLV-1h72 | GLV-1h73 |
| 16 | 126.0 | 170.6 | 148.9 | 135.8 | 140.5 |
| 22 | 268.0 | 294.9 | 338.3 | 342.3 | 362.7 |
| 29 | 518.3 | 683.4 | 568.1 | 604 | 575 |
| 36 | 768.9 | 882.7 | 766.4 | 709.7 | 663.2 |
| 44 | 1004.1 | 586.0 | 802.4 | 418.85 | 398.1 |
| 51 | 1322.4 | 283.6 | 783.9 | 263.9 | 271.6 |
| 57 | 1913.0 | * | 897.6 | 177 | 210.5 | control group of mice was not given any treatment. Tumor volume (mm³) was measured at 34, 41, 49, 57, 64, 71, 78, 85 and 92 days post-cancer cell injection. Results of median tumor volume are provided in Table 27.

GLV-1h73 and GLV-1h74 showed antitumor activities similar to their corresponding A35R-deleted strains, GLV-1j88 and GLV-1j89, respectively. A35R-deleted strain GLV-1j87 showed significantly enhanced antitumor activity as compare to its corresponding strain of GLV-1h68. The A35R deletion was able to attenuate the toxicity of the GLV-1h68 virus and provide a greater tumor response (see GLV-1j87 in Table 26). The A35R deletion did not decrease the toxicity of the GLV-1h73 or GLV-1h74 strains (see GLV-1j88, 1j89 in Table 26).

TABLE 27

Median tumor volumes at different time points after i.v. injection of different virus strains into nude mice bearing GI-101A tumors

| Days post-implantation of tumor cells | Median tumor volume (mm³) | | | | | | |
|---|---|---|---|---|---|---|---|
| | No Treatment | GLV-1h68 | GLV-1h73 | GLV-1h74 | GLV-1j87 | GLV-1j88 | GLV-1j89 |
| 34 | 305.2 | 306.6 | 351.1 | 534.75 | 377.5 | 353.3 | 325.45 |
| 41 | 459.2 | 444.75 | 590.65 | 881.5 | 673.35 | 677.45 | 753.05 |
| 49 | 794.85 | 777.05 | 923.15 | 1259.8 | 1126.85 | 988 | 1095.95 |
| 57 | 1253.4 | 1102.95 | 1109.5 | 1181.4 | 1271.95 | 1023.85 | 975.75 |
| 64 | * | 1204.5 | 691.85 | 280.5 | 1125.85 | 715.45 | 497.5 |
| 71 | * | 1239.85 | 318.15 | 33.8 | 1130.35 | 340.9 | * |
| 78 | * | 1347.2 | 106.65 | * | 931.9 | * | * |
| 85 | * | 1261.95 | 8.05 | * | 755.2 | * | * |
| 92 | * | 1061.15 | 0 | * | 599.5 | * | * |

Example 17

Effects of A35R Deletion on Virulence and Tumor Growth In Vivo

A. Effects of Modified Viruses Administered to Female Nude Mice on S.C. Human Breast Tumor Xenografts The in vivo effects of removal of the A35R gene on virulence and tumor shrinkage induced by the modified vaccinia strains were evaluated using a mouse model of breast cancer. Strains GLV-1h68, GLV-1h73 and GLV-1h74 were evaluated with their corresponding A35R-deleted strains GLV-1j87, GLV-1j88 and GLV-1j89, respectively. Tumors were established in nude mice by subcutaneously injecting GI-101A human breast carcinoma cells (s.c. on the right lateral thigh; 5×10⁶ cells; GI-101A cells: Rumbaugh-Goodwin Institute for Cancer Research Inc. Plantation, Fla.; U.S. Pat. No. 5,693,533) into female nude mice (Hsd:Athymic Nude-Foxn1$^{nu}$; Harlan, Indianapolis, Ind.) (n=4-8). Thirty three days following tumor cell implantation, groups of mice were injected intravenously [in 100 µl of PBS, through femoral vein under anesthesia] with 5×10⁶ PFU of GLV-1h68, GLV-1h73, GLV-1h74, GLV-1j87, GLV-1j88 and GLV-1j89, respectively. The B. Effects of A35R Deletion on Virulence Following Intranasal Administration The in vivo effect of removal of the A35R gene on virulence of intranasally administered modified vaccinia strains was evaluated. Strains GLV-1h68, GLV-1h73 and GLV-1h74 were evaluated with their corresponding A35R-deleted strains GLV-1j87, GLV-1j88 and GLV-1j89, respectively. Groups of eight male BALB/c 5-week-old mice were anesthetized and intranasally challenged with varying concentrations of each virus, 1×10⁵, 1×10⁶ or 1×10⁷ PFU, in 20 µl 10 mM Tris-HCl (pH 9.0) or PBS control. Individual mice were weighed three times every week.

Over the observation period, all mice exhibited significant weight gain. The increasing concentrations of each virus slightly decreased the percentage weight gain; however, the A35R mutation did not significantly alter the percentage weight gain of corresponding vaccinia viruses in the mice. Thus, removal of A35R from the viruses does not appear to affect virulence via intranasal administration.

Example 18

Effects of IL-6 and IL-24 Expressing Viruses on Breast Tumor Growth In Vivo

A. Effects of Modified Viruses on S.C. Human Breast Tumor Xenografts

The in vivo effects of IL-6 expressing viruses GLV-1h90 and GLV-1h91 and GLV-1h92 and IL-24-expressing viruses GLV-1h96, GLV-1h97 and GLV-1h98 compared to virus strains GLV-1h68, GLV-1h71 and Dark8.1 on tumor growth were evaluated using a mouse model of breast cancer. The Dark8.1 strain was isolated from a culture of GLV-1h68 by selection dark plaques under fluorescence microscope and subsequent plaque purification. Dark8.1 has an intact F14.5L gene, which is identical in sequence to F14.5L of LIVP. (The lacZ and gusA genes at the TK and HA loci, respectively, in Dark8.1 are still intact).

Tumors were established in nude mice by subcutaneously injecting GI-101A human breast carcinoma cells (s.c. on the right lateral thigh; $5\times10^6$ cells; GI-101A cells: Rumbaugh-Goodwin Institute for Cancer Research Inc. Plantation, Fla.; U.S. Pat. No. 5,693,533) into female nude mice (Hsd:Athymic Nude-Foxn1$^{nu}$; Harlan, Indianapolis, Ind.) (n=4-8). Thirty three days following tumor cell implantation, groups of mice were injected intravenously [in 100 μl of PBS, through femoral vein under anesthesia] with $5\times10^6$ PFU of GLV-1h68, Dark 8.1, GLV-1h71, GLV-1h90, GLV-1h91, GLV-1h92, GLV-1h96, GLV-1h97 and GLV-1h98, respectively. The control group of mice was not given any treatment. Tumor volume (mm$^3$) was measured at 31, 39, 54, 62, 69, 76 and 97 days post-cancer cell injection. Results of median tumor volume are provided in Table 28. GLV-1h90 (expressing IL-6) and GLV-1h96 (expressing IL-24) showed enhanced antitumor response as compared to the corresponding virus GLV-1h68, which does not express IL-6 or IL-24.

Example 19

Effects of Modified Viruses on Pancreatic Tumor Growth In Vivo

A. Effects of Modified Viruses on Human Pancreatic Tumors—PANC-1 Model

The in vivo effects of GLV-1h68, GLV-1h71, GLV-1h73, GLV-1h81 (hk5-expressing), GLV-1h90 (sIL-6R-IL-6 expressing) and GLV-1h96 (IL-24 expressing) viruses were evaluated using a mouse model of human pancreatic cancer. Tumors were established in nude mice by subcutaneously injecting $5\times10^6$ PANC-1 human pancreatic carcinoma cells (ATCC No. CRL-1469) subcutaneously in right lateral thigh of male nude mice (Hsd:Athymic Nude-Foxn1$^{nu}$; Harlan, Indianapolis, Ind.; n=3-8 mice/group). Twenty seven days following tumor cell implantation, groups of mice were injected intravenously [in 100 μl of PBS, through femoral vein under anesthesia] with $5\times10^6$ PFU of GLV-1h68, GLV-1h71, GLV-1h73, GLV-1h81, GLV-1h90 and GLV-1h96, respectively. The control group of mice was not given any treatment. Tumor volume (mm$^3$) was measured at 26, 33, 41, 49, 56, 68, 76 and 85 days post-cancer cell injection. Results of median tumor volume are provided in Table 29.

GLV-1h81 (hk5-expressing), GLV-1h90 (sIL-6R-IL-6 expressing), and GLV-1h96 (IL-24 expressing) viruses showed significantly accelerated antitumor responses as compared to GLV-1h68 (Table 29). Among these four viruses, GLV-1h96 showed the best antitumor activity. In addition,

TABLE 28

Median tumor volumes at different time points after i.v. injection of different virus strains into nude mice bearing GI-101A tumors

| Days post-implantation of tumor cells | No Treatment | GLV-1h68 | Dark 8.1 | GLV-1h71 | GLV-1h90 | GLV-1h91 | GLV-1h92 | GLV-1h96 | GLV-1h97 | GLV-1h98 |
|---|---|---|---|---|---|---|---|---|---|---|
| | | | | | Median tumor volume (mm$^3$) | | | | | |
| 31 | 777.55 | 578 | 523.7 | 571.4 | 445.6 | 485.6 | 609 | 505.1 | 505.3 | 716.4 |
| 39 | 1124.4 | 967.8 | 1147.6 | 1012.95 | 942 | 860 | 905.4 | 939.4 | 829.8 | 1326.3 |
| 54 | 3535.1 | 2059.4 | 1997 | 1991 | 1110.8 | 521.8 | 811.7 | 1864.3 | 1456.9 | 2266.8 |
| 62 | * | 2669.05 | 1184.3 | 2144.8 | 1337.3 | * | * | 1969.9 | 2326.3 | 2193.2 |
| 69 | * | 578 | 1008.25 | * | 1219.4 | * | * | 1820.75 | 2483.55 | 1957.8 |
| 76 | * | * | 452.15 | * | 1378.9 | * | * | 1488.85 | 2243.25 | 1419.6 |
| 97 | * | * | 154.5 | * | 155.4 | * | * | 311.3 | 1131.5 | 945.1 | based on net body weight changes, mice treated with GLV-1h81, GLV-1h90, and GLV-1h96 gained 5-10% more weight than mice treated GLV-1h68, which may indicate that GLV-1h81, GLV-1h90, and GLV-1h96 are less toxic to mice (Table 30). Nonetheless, mice treated with GLV-1h68, GLV-1h81, GLV-1h90, and GLV-1h96 all gained significant weight during the course of viral treatment.

TABLE 29

Median tumor volumes at different time points after i.v. injection of different virus strains into nude mice bearing PANC-1 tumors

| Days post-implantation of tumor cells | No Treatment | GLV-1h68 | GLV-1h71 | GLV-1h73 | GLV-1h81 | GLV-1h90 | GLV-1h96 |
|---|---|---|---|---|---|---|---|
| | | Median tumor volume (mm$^3$) | | | | | |
| 26 | 234 | 252.2 | 195.25 | 171.6 | 197.75 | 191.4 | 169.05 |
| 33 | 387.8 | 458.25 | 405.5 | 352.15 | 352.8 | 492.9 | 384.65 |
| 41 | 669 | 796.25 | 625.25 | 638.15 | 547.1 | 633.15 | 547.1 |

TABLE 29-continued

Median tumor volumes at different time points after i.v. injection of different virus strains into nude mice bearing PANC-1 tumors

| Days post-implantation of tumor cells | Median tumor volume (mm³) | | | | | | |
|---|---|---|---|---|---|---|---|
| | No Treatment | GLV-1h68 | GLV-1h71 | GLV-1h73 | GLV-1h81 | GLV-1h90 | GLV-1h96 |
| 49 | 834.7 | 877.7 | 480.4 | 552.45 | 645.55 | 720.65 | 341.25 |
| 56 | 1258.8 | 823.35 | 384.95 | 313 | 589.2 | 555 | 229.5 |
| 68 | 1990 | 616.35 | 303.35 | 291.25 | 422.6 | 262 | 157.2 |
| 76 | 3056.1 | 436.95 | 236.6 | * | 362.55 | 182.95 | 124.4 |
| 85 | 4627.4 | 307.25 | 201.1 | * | 256.85 | 133.1 | 81.15 |
| 98 | * | 218.4 | 119.7 | * | 172.45 | 129.55 | 41.8 |
| 106 | * | 157.95 | * | * | 141.25 | 110.7 | 43.8 |

Comparison of tumor volumes for each of the eight individual mice injected with either GLV-1h68 (Mice ID Nos. 6060-6067) or GLV-1h90 (Mice ID Nos. 6116-6123) are presented in Tables 30 and 31, respectively. Variations in tumor sizes were seen at different time points in the mice following GLV-1h90 injection; however, by 80 days following treatment, only tumor remnants remained in most mice. Much smaller variations in tumor sizes were seen at different time points in mice treated with GLV-1h68, though the average tumor response was significantly slower as compared to GLV-1h90. Similar to mice treated with GLV-1h90, only tumor remnants were seen by 80 days after GLV-1h68 injection.

TABLE 30

Median tumor volumes at different time points after i.v. injection of GLV-1h68 into nude mice bearing PANC-1 tumors

| Days post-implantation of tumor cells | Median tumor volume (mm³) | | | | | | | |
|---|---|---|---|---|---|---|---|---|
| | 6060 | 6061 | 6062 | 6063 | 6064 | 6065 | 6066 | 6067 |
| 26 | 272.1 | 193.3 | 257.8 | 339.4 | 163.1 | 165.2 | 246.6 | 351.2 |
| 33 | 474.6 | 539.1 | 426.8 | 578.1 | 294.7 | 340.6 | 441.9 | 649.6 |
| 41 | 819.5 | 997.9 | 731.9 | 1096.9 | 460.5 | 532.6 | 773.9 | 818.6 |
| 49 | 981.5 | 815.3 | 911.8 | 930.7 | 557.9 | 843.6 | 764.3 | 1153.2 |
| 56 | 819.9 | 762.7 | 826.8 | 757.5 | 857.5 | 956.2 | 553.6 | 1064.9 |
| 68 | 812 | 601.2 | 484.9 | 631.5 | 715.8 | 445.7 | 338.8 | 703.2 |
| 76 | 564.9 | 593.9 | 332.4 | 374.8 | 634.3 | 228 | 284.3 | 499.1 |
| 85 | 488.6 | 528.7 | 256.7 | 311.3 | 635.3 | 137.5 | 301.6 | 303.2 |
| 98 | 301.9 | 402.8 | 218.4 | 123.4 | 507.3 | 64.2 | 187.4 | nd |
| 106 | 210.8 | 176.7 | 128.5 | nd | 259.9 | 45.6 | 139.2 | nd |

TABLE 31

Median tumor volumes at different time points after i.v. injection of GLV-1h90 into nude mice bearing PANC-1 tumors

| Days post-implantation of tumor cells | Median tumor volume (mm³) | | | | | | | |
|---|---|---|---|---|---|---|---|---|
| | 6116 | 6117 | 6118 | 6119 | 6120 | 6121 | 6122 | 6123 |
| 26 | 377 | 169.9 | 209.3 | 281.8 | 173.5 | 137.3 | 130.8 | 212.7 |
| 33 | 631.2 | 532 | 453.8 | 785.6 | 323.5 | 370.3 | 291.9 | 749.3 |
| 41 | 850.3 | 757.8 | 497.7 | 881 | 508.5 | 416.5 | 294.5 | 958.4 |
| 49 | 755.9 | 691.5 | 576 | 935.4 | 749.8 | 360.4 | 205.2 | 1178.8 |
| 56 | 668.3 | 589.4 | 352.5 | 520.6 | 765.4 | 161.7 | 109.4 | 879.9 |
| 68 | 345.4 | 332.4 | 152.9 | 227.2 | 748.5 | 75.8 | 84.5 | 296.8 |
| 76 | 233.2 | 298.3 | 98.6 | 219.2 | 598.7 | 102.3 | 69.2 | 146.7 |
| 85 | 164.8 | 136.1 | 74.7 | 130.1 | 610.2 | 43.8 | 64.6 | 168.1 |
| 98 | 148.8 | 167.3 | 51.2 | 110.3 | 587.9 | 63.4 | 0 | 211.6 |
| 106 | 137.5 | 125.6 | 41.7 | 95.8 | 282.9 | 68.6 | 0 | 269.1 |

B. Effects of Modified Viruses on Human Pancreatic Tumors-MIA PaCa-2 Model

The in vivo effects of GLV-1h68, GLV-1h72, GLV-1h73, GLV-1h81, GLV-1h90 and GLV-1h96 were evaluated using a second mouse model of human pancreatic cancer. Tumors were established in nude mice by subcutaneously injecting $5 \times 10^6$ cells MIA PaCa-2 human pancreatic carcinoma cells (ATCC No. CRL-1420) subcutaneously on right lateral thigh of male nude mice (Hsd:Athymic Nude-Foxn1$^{nu}$; Harlan, Indianapolis, Ind.; n=3-8 mice/group). Twenty-nine days following tumor cell implantation, groups of mice were injected intravenously [in 100 μl of PBS, through femoral vein under anesthesia] with $5 \times 10^6$ PFU of GLV-1h68, GLV-1h72, GLV-1h73, GLV-1h81, GLV-1h90 and GLV-1h96, respectively. The control group of mice was not given any treatment. Tumor volume (mm³) was measured at 30, 36, 45, 52 and 58 days post-cancer cell injection. Results of median tumor volume (mm³) are provided in Table 32. GLV-1h90 (sIL-6R-IL-6 expressing) and GLV-1h96 (IL-24 expressing) showed significantly accelerated antitumor response as compared to GLV-1h68. Among these three viruses, GLV-1h96 showed the best antitumor activity at 28 days after virus injection.

TABLE 32

Median tumor volumes at different time points after i.v. injection of different virus strains into nude mice bearing MIA-PaCa-2 tumors

| Days post-implantation of tumor cells | Median tumor volume (mm³) | | | | | | |
|---|---|---|---|---|---|---|---|
| | No Treatment | GLV-1h68 | GLV-1h72 | GLV-1h73 | GLV-1h81 | GLV-1h90 | GLV-1h96 |
| 30 | 904.8 | 761.1 | 723.7 | 587 | 657.6 | 625.55 | 527.4 |
| 36 | 1806.4 | 1482.15 | 1457.6 | 1270.7 | 1322.7 | 1067.85 | 1243.05 |
| 45 | 4641.7 | 1223.1 | 1112.3 | 1180.15 | 1508.5 | 1233.8 | 1154.3 |
| 52 | * | 1175.85 | 584.6 | 749.25 | 1042.7 | 853.55 | 736.45 |
| 58 | * | 1073.15 | 467.8 | 603.2 | 984.8 | 681.95 | 546.05 |

C. Effects of Viruses on Body Weight in a Mouse Model of Human Pancreatic Tumors—PANC-1 Model The percentage of body weight change following intravenous administration of the viruses in the PANC-1 mouse model of human pancreatic cancer was also examined (Table 33). Percentage of body weight change was measured for the experiment described in Section A. Mice treated with GLV-1h68, GLV-1h81 and GLV-1h90 gained significant weight (all much better than the untreated group) during the course of viral treatment.

TABLE 33

Body weight change at different time points after i.v. injection of different virus strains into nude mice bearing PANC-1 tumors

| Days post-implantation of tumor cells | Body weight Change (%) | | | | | | |
|---|---|---|---|---|---|---|---|
| | No Treatment | GLV-1h68 | GLV-1h71 | GLV-1h73 | GLV-1h81 | GLV-1h90 | GLV-1h96 |
| 26 | 0 | 0 | 0 | 0 | 0 | 0 | 0 |
| 33 | −0.36 | −2.4 | −0.59 | −4.76 | −3.72 | −6.06 | −5.09 |
| 41 | 0 | −6.85 | −2.74 | −4.17 | −5.02 | −7.39 | −4.28 |
| 49 | −2.91 | −2.78 | 11.74 | 7.14 | 3.35 | 3.98 | 11.81 |
| 56 | 1.09 | 7.04 | 9.98 | 9.52 | 11.15 | 16.29 | 16.5 |
| 68 | −3.27 | 11.11 | 12.33 | −13.49 | 15.24 | 17.05 | 11.2 |
| 76 | −3.27 | 11.3 | 8.61 | nd | 15.8 | 21.4 | 10.59 |
| 85 | −6.18 | 13.7 | 5.68 | nd | 18.22 | 22.16 | −0.41 |

Example 20

IL-6 ELISA Correlation of IL-6 with Tumor Volume

The relationship between tumor volume and the amount of IL-6 expressed by injected viruses was evaluated in a mouse model of pancreatic cancer. Tumors were established in nude mice by subcutaneously injecting $5 \times 10^6$ cells PANC-1 human pancreatic carcinoma cells (ATCC No. CRL-1469) subcutaneously on right lateral thigh of male nude mice (Hsd: Athymic Nude-Foxn1$^{nu}$; Harlan, Indianapolis, Ind.; n=8 mice/group). Twenty-seven days following tumor cell implantation, groups of mice were injected intravenously [in 100 μl of PBS, through femoral vein under anesthesia] with $5 \times 10^6$ PFU of either GLV-1h68 or GLV-1h90. At 56 days post-cancer cell injection, tumor volume (mm³) was measured and samples of tumor fluid (~10-20 μl through needle puncture) and blood serum (~500 μl through retroorbital bleeding) were collected to measure IL-6 concentration by ELISA.

For comparison, production of IL-6 was also measured from CV-1 cells infected with virus. CV-1 cells in 6-well plates ($1.0 \times 10^6$ cells/well) were mock infected or infected in triplicate with GLV-1h68, -1h90, -1h91 or -1h92 at m.o.i of 10 for 1 hour at 37° C. The inoculum was aspirated and the cell monolayers were washed twice with 2 ml of DPBS (Mediatech, Inc., Herndon, Va.). Two ml of DMEM-2 were added into each well. The infected medium was collected at 24 h post infection and clarified by centrifugation at 3,000 rpm for 5 min.

The concentration of human IL-6 in the culture supernatants, mouse sera, and tumor fluids was quantified by Human IL-6 ELISA kit (Cell Sciences, Inc., Catalog No: CKH106) following the manufacturer's instructions. The culture supernatant samples were diluted 1:1000 or 1:5000, the mouse serum samples were diluted 1:100, and the tumor fluid samples were diluted 1:300. The standards and test samples were assayed in duplicate, and the absorbance at 450 nm was measured. The average absorbance obtained for each standard was used to generate the standard curve. The concentration of human IL-6 in each test sample was interpolated from the standard curve. Results for the IL-6 ELISA are shown in Table 34.

TABLE 34

IL-6 concentration following in vitro infection of CV-1 cells or in vivo i.v. injection of different virus strains into nude mice bearing PANC-1 tumors

| | Sample | OD-OD.bl (450 nm) | IL-6 (ng/ml) | Dilution Factor | Concentration (mean) |
|---|---|---|---|---|---|
| Cell Culture Supernatant | Mock-1 | −0.002 | n.d. | 1:1000 | n.d. |
| | Mock-2 | −0.002 | n.d. | 1:1000 | |
| | Mock-3 | −0.001 | n.d. | 1:1000 | |
| | GLV-1h68-1 | 0.001 | n.d. | 1:1000 | n.d. |
| | GLV-1h68-2 | 0.001 | n.d. | 1:1000 | |
| | GLV-1h68-3 | −0.002 | n.d. | 1:1000 | |
| | GLV-1h90-1 | 0.553 | 0.031 | 1:1000 | 42 ng/ml |
| | GLV-1h90-2 | 0.703 | 0.042 | 1:1000 | |
| | GLV-1h90-3 | 0.806 | 0.053 | 1:1000 | |
| | GLV-1h91-1 | 1.159 | 0.108 | 1:5000 | 635 ng/ml |
| | GLV-1h91-2 | 1.410 | 0.162 | 1:5000 | |
| | GLV-1h91-3 | 1.171 | 0.111 | 1:5000 | |
| | GLV-1h92-1 | 1.071 | 0.092 | 1:5000 | 562 ng/ml |
| | GLV-1h92-2 | 1.232 | 0.122 | 1:5000 | |
| | GLV-1h92-3 | 1.243 | 0.123 | 1:5000 | |
| Mouse Serum | GLV-1h68 (8) | −0.001 | n.d. | 1:100 | n.d |
| | GLV-1h90-1 | 0.0912 | 0.0055 | 1:100 | 0.55 ng/ml |
| | GLV-1h90-2 | 0.0496 | 0.0021 | 1:100 | 0.21 ng/ml |
| | GLV-1h90-3 | 0.0694 | 0.0034 | 1:100 | 0.34 ng/ml |
| | GLV-1h90-4 | 0.1250 | 0.0082 | 1:100 | 0.82 ng/ml |
| | GLV-1h90-5 | 0.1196 | 0.0075 | 1:100 | 0.75 ng/ml |
| | GLV-1h90-6 | 0.0466 | 0.0020 | 1:100 | 0.20 ng/ml |
| | GLV-1h90-7 | 0.0046 | 0.0014 | 1:100 | 0.14 ng/ml |

TABLE 34-continued

IL-6 concentration following in vitro infection of CV-1 cells or in vivo i.v. injection of different virus strains into nude mice bearing PANC-1 tumors

|  | Sample | OD-OD.bl (450 nm) | IL-6 (ng/ml) | Dilution Factor | Concentration (mean) |
|---|---|---|---|---|---|
|  | GLV-1h90-8 | 0.1591 | 0.0089 | 1:100 | 0.89 ng/ml |
| Tumor | GLV-1h68 (8) | −0.001 | n.d. | 1:300 | n.d. |
| Fluid | GLV-1h90-1 | 1.125 | 0.173 | 1:300 | 51.9 ng/ml |
|  | GLV-1h90-2 | 1.481 | 0.277 | 1:300 | 83.1 ng/ml |
|  | GLV-1h90-3 | 0.377 | 0.026 | 1:300 | 7.8 ng/ml |
|  | GLV-1h90-4 | 1.312 | 0.196 | 1:300 | 58.8 ng/ml |
|  | GLV-1h90-5 | 0.793 | 0.071 | 1:300 | 21.3 ng/ml |
|  | GLV-1h90-6 | 0.672 | 0.054 | 1:300 | 16.2 ng/ml |
|  | GLV-1h90-7 | 0.779 | 0.069 | 1:300 | 20.7 ng/ml |
|  | GLV-1h90-8 | 1.143 | 0.140 | 1:300 | 42.0 ng/ml |

OD. bl = OD value measured for the blank control.
n.d. = not detected.

Results for median tumor volume compared to IL-6 concentration are provided in Table 35 for GLV-1h90, which expresses IL-6, and Table 36 for GLV-1h68, which does not express IL-6. In the 1h90 treated animals, high amounts of IL-6 were found in the cell culture, tumor fluid and blood serum as compared to the samples from mice treated with 1h68 control, which does not express IL-6.

During the tumor shrinking phase of the treatment (56 days post implantation of the tumor cells), in the GLV-1h90 treated animals, the concentration of IL-6 in the tumor fluid and in the serum is positively correlated to the tumor volume. This is because the larger tumor volume sustains higher virus replication. The smaller tumors, which are already shrunk by the virus treatment, have less tumor tissue in which the virus can replicate, and thus display a lower level of IL-6. In the control GLV-1h68 treated animals, the animals intrinsically express low levels of IL-6; however, there is no correlation between tumor volume and IL-6 concentration.

TABLE 35

IL-6 concentration versus tumor volume following i.v. injection of GLV-1h90 into mice bearing PANC-1 tumors

| Mouse ID (GLV-1h90 injected) | [IL-6] in tumor fluid (1:300) | Tumor volume ($mm^3$) at 56 days | Tumor volume ($mm^3$)/ 500 | [IL-6] in serum fluid |
|---|---|---|---|---|
| 6116 | 1.1248 | 668.3 | 1.34 | 0.912 |
| 6117 | 1.4813 | 589.4 | 1.18 | 0.496 |
| 6118 | 0.3774 | 352.5 | 0.71 | 0.694 |
| 6119 | 1.3121 | 520.6 | 1.04 | 1.25 |
| 6120 | 0.7927 | 765.4 | 1.53 | 1.196 |
| 6121 | 0.6723 | 161.7 | 0.32 | 0.4066 |
| 6122 | 0.7785 | 109.4 | 0.22 | 0.046 |
| 6123 | 1.1425 | 879.9 | 1.76 | 1.591 |

TABLE 36

IL-6 concentration versus tumor volume following i.v. injection of GLV-1h68 into mice bearing PANC-1 tumors

| Mouse ID (GLV-1h68 injected) | [IL-6] in tumor fluid (1:300) | Tumor volume ($mm^3$) at 56 days | Tumor volume ($mm^3$)/ 500 | [IL-6] in serum fluid |
|---|---|---|---|---|
| 6060 | −0.0102 | 819.9 | 0.0041 | −0.0248 |
| 6061 | −0.0077 | 762.7 | 0.00381 | −0.0108 |
| 6062 | −0.0032 | 826.8 | 0.004134 | −0.0088 |
| 6063 | 0.0072 | 757.5 | 0.00379 | 0.0044 |
| 6064 | 0.0093 | 857.5 | 0.00429 | 0.0017 |
| 6065 | 0.0087 | 956.2 | 0.004781 | −0.0089 |
| 6066 | −0.0049 | 553.6 | 0.002768 | −0.0157 |
| 6067 | −0.0042 | 1064.9 | 0.00532 | −0.0093 |

Example 21

Effects of Modified Viruses on Prostate Tumor Growth In Vivo

A. Effects of Viruses Administered to Female Nude Mice on Human Prostate Carcinoma The in vivo effects of GLV-1h68, GLV-1h90, GLV-1h96 or a combination of GLV-1h90 and GLV-1h96 were evaluated using two mouse models of human prostate cancer. In the first model, the in vivo effects of GLV-1h68, GLV-1h90, GLV-1h96 or a combination of GLV-1h90 and GLV-1h96 on DU145 human prostate tumors was assessed. Tumors were established by subcutaneous implantation of $1 \times 10^7$ DU145 human prostate cancer cells (ATCC# HTB-81) in the right lateral thigh of male nude mice (Hsd:Athymic Nude-Foxn1$^{nu}$; Harlan, Indianapolis, Ind.; n=3-8 mice/group). Nineteen days following tumor cell implantation, groups of mice were injected intravenously [in 100 µl of PBS, through femoral vein under anesthesia] with $5 \times 10^6$ PFU of GLV-1h68, GLV-1h90, or GLV-1h96, or $2.5 \times 10^6$ PFU each of GLV-1h90 and GLV-1h96. Median tumor volumes ($mm^3$) were measured using a digital caliper on day 18, 25, 31, 39, 45, 54, and 61 (days after tumor cell implantation). Results are shown in Table 37a.

In the second model, the in vivo effects of GLV-1h68 on PC-3 human prostate tumors was assessed. Tumors were established by subcutaneous implantation of $1 \times 10^7$ PC-3 human prostate cancer cells (ATCC# CRL-1435) in the right lateral thigh of nude mice (Hsd:Athymic Nude-Foxn1nu; Harlan, Indianapolis, Ind.). Following tumor cell implantation, groups of mice were injected intravenously either through the femoral vein (f.v.) or through the tail vein (t.v.) with $5 \times 10^6$ PFU of GLV-1h68 in 100 µl of PBS. Median tumor volumes ($mm^3$) were measured using a digital caliper on days 27, 42, 50, 56, 63, 71, 78, 86, 105, 114, 133 and 146 after tumor cell implantation. Results are shown in Table 37b.

GLV-1h90 (sIL-6R-IL-6 expressing), GLV-1h96 (IL-24 expressing), and GLV-1h90 plus GLV-1h96 combination treatments of mice bearing DU145 tumors showed significantly accelerated and enhanced antitumor response as compared to GLV-1h68 (Table 37a). Among these four treatment groups, GLV-1h96 and GLV-1h90 plus GLV-1h96 combination treatments showed the best antitumor activities. Tumors were eradicated in almost all mice in these two treatment groups 43 days after virus injection.

TABLE 37a

Median tumor volumes at different time points after i.v. injection of different virus strains into nude mice bearing DU145 tumors

| Days post-implantation of tumor cells | Median tumor volume (mm³) | | | | |
|---|---|---|---|---|---|
| | No Treatment | GLV-1h68 | GLV-1h90 | GLV-1h96 | GLV-1h90 + GLV-1h96 |
| 18 | 423.55 | 430.55 | 440.6 | 436.9 | 388.3 |
| 25 | 794.55 | 703.75 | 832.35 | 803.35 | 751.05 |
| 31 | 1036.05 | 1011.2 | 1025 | 952.3 | 1045.45 |
| 39 | 1278.9 | 1123.05 | 828.15 | 910.4 | 923.15 |
| 45 | 1649.9 | 1031 | 639.25 | 644.75 | 449.7 |
| 54 | 1746.8 | 951.5 | 452.15 | 238.75 | 214.05 |
| 61 | 2068.8 | 766.1 | 369.8 | 5.15 | 87.25 |

Administration of GLV-1h68, via to the tail vein or femoral vein, to mice bearing PC-3 tumors resulted in similar tumor progression to that seen in mice that were not treated (Table 37b). Administration of GLV-1h68 via the tail vein resulted in slightly slower tumor growth compared with tumor growth in untreated mice.

TABLE 37b

Median tumor volumes at different time points after i.v. injection into the tail vein or femoral vein of GLV-1h68 into nude mice bearing PC-3 tumors

| Days post-implantation of tumor cells | Median tumor volume (mm³) | | |
|---|---|---|---|
| | No Treatment | GLV-1h68 (t.v.) | GLV-1h68 (f.v.) |
| 27 | 38.05 | 28.55 | 37.8 |
| 42 | 158.25 | 145.8 | 111.45 |
| 50 | 188.15 | 247.25 | 146.2 |
| 56 | 215.3 | 259.45 | 187 |
| 63 | 373.15 | 330.55 | 323.5 |
| 71 | 446.1 | 381.15 | 322.05 |
| 78 | 546.15 | 525.9 | 408.9 |
| 86 | 679.8 | 718.1 | 549.7 |
| 105 | 1335.35 | 1000.9 | 1114.85 |
| 114 | 1499.9 | 1423 | 1522.8 |
| 133 | 2685.2 | 2162.4 | 2719.8 |
| 146 | 3342.45 | 2627.95 | 3120.1 |

B. Effects of Viruses on Body Weight in a Mouse Model of Human Prostate Cancer

The percentage of body weight change following intravenous administration of the viruses in the mouse model of human prostate cancer was also examined (Table 38. Percentage of body weight change was measured for the experiment described in Section A. Mice in all treatment groups gained significant weight (equal to or better than the untreated group) and remained healthy during the course of viral treatment.

TABLE 38

Body weight change at different time points after i.v. injection of different virus strains into nude mice bearing DU145 tumors

| Days | Body weight Change (%) | | | | |
|---|---|---|---|---|---|
| | No Treatment | GLV-1h68 | GLV-1h90 | GLV-1h96 | GLV-1h90 + GLV-1h96 |
| 18 | 0 | 0 | 0 | 0 | 0 |
| 25 | 6.39 | 1.62 | -1.3 | 0.81 | 1.46 |
| 31 | 5.01 | 0.97 | -0.49 | 2.75 | 0.49 |
| 39 | 5.01 | 4.7 | 6.68 | 3.23 | 1.79 |
| 45 | 9.67 | 6.16 | 9.78 | 7.27 | 7.97 |
| 54 | 9.15 | 9.89 | 7.98 | 5.33 | 9.11 |
| 61 | 5 | 10.5 | 7.98 | 10.18 | 5.53 |

Example 22

Effect of Erbitux or Avastin Combination Therapies on Human Pancreatic Carcinomas In Vivo A. Effects of Modified Viruses with Erbitux or Avastin on Tumor Growth Tumors were established in nude mice by subcutaneously injecting 5×10⁶ cells PANC-1 human pancreatic carcinoma cells (ATCC No. CRL-1469) subcutaneously on the right lateral thigh of male nude mice (Hsd:Athymic Nude-Foxn1$^{nu}$; Harlan, Indianapolis, Ind.; n=3-8 mice/group). Twenty seven days following tumor cell implantation, groups of mice were injected intravenously [in 100 μl of PBS, through femoral vein under anesthesia] with 5×10⁶ PFU of GLV-1h68. For the combination treatments, Erbitux was administered i.p. at a dose of 3 mg/kg twice a week for five consecutive weeks) and Avastin was administered i.p. at a dose of 5 mg/kg twice a week for five consecutive weeks. The control group of mice was not given any treatment. Tumor volume (mm³) was measured at 26, 33, 41, 49, 56, 68, 76, 85, 98 and 106 days post-cancer cell injection. Results of median tumor volume are provided in Table 39. Avastin exhibited a significant enhancement of tumor regression when used in combination with GLV-1h68, whereas Erbitux treatment slightly improved tumor regression when used in combination with GLV-1h68. In addition, mice remained healthy following GLV-1h68 and Avastin treatment.

TABLE 39

Median tumor volumes at different time points after i.v. injection of GLV-1h68 into nude mice bearing PANC-1 tumors with or without Erbitux or Avastin combination therapy

| Days | Median tumor volume (mm³) | | | | | |
|---|---|---|---|---|---|---|
| | No Treatment | GLV-1h68 | GLV-1h68 + Erbitux | Erbitux | GLV-1h68 + Avastin | Avastin |
| 26 | 234 | 252.2 | 170.9 | 190.15 | 230.75 | 221.5 |
| 33 | 387.8 | 458.25 | 420 | 382.45 | 422.05 | 366.3 |
| 41 | 669 | 796.25 | 695.15 | 507.7 | 628.7 | 537.65 |
| 49 | 834.7 | 877.7 | 724.3 | 785.65 | 648.5 | 742.8 |
| 56 | 1258.8 | 823.35 | 617.8 | 1126.35 | 449.6 | 988.9 |
| 68 | 1990 | 616.35 | 437.1 | 1926.6 | 275.55 | 1450 |
| 76 | 3056.1 | 436.95 | 382.9 | 2684.15 | 255.45 | 1919.85 |
| 85 | 4627.4 | 307.25 | 294.3 | 4283.6 | 205.3 | 2556.3 |
| 98 | * | 218.4 | 236.2 | * | 141 | * |
| 106 | * | 157.95 | 212.05 | * | 143.8 | * |

B. Effects of Combination Therapy on Body Weight in a Mouse Model of Human Pancreatic Cancer The percentage of body weight change following intravenous administration of the viruses in the PANC-1 mouse model of human pancreatic cancer was also examined (Table 40). Percentage of body weight change was measured for the experiment described in Section A.

Mice injected with GLV-1h68 alone, GLV-1h68 plus Erbitux, and GLV-1h68 plus Avastin treatment groups gained significant weight, which was significantly better than the untreated, treated with Erbitux alone, or treated with Avastin alone groups, and remained healthy during the course of viral treatment.

noma cells (ATCC No. CRL-1420) subcutaneously on the right lateral thigh of male nude mice (Hsd:Athymic Nude-Foxn1$^{nu}$; Harlan, Indianapolis, Ind.; n=3-8 mice/group). Twenty-nine days following tumor cell implantation, groups of mice were injected intravenously [in 100 µl of PBS, through femoral vein under anesthesia] with 5×10$^6$ PFU of GLV-1h68 viruses. For the combination treatment, Avastin was administered i.p. at a dose of 5 mg/kg twice a week for five consecutive weeks. The control group of mice was not given any treatment. Tumor volume (mm$^3$) was measured at 30, 36, 45, 52, and 58 days after tumor cell implantation. Results for median tumor volume are provided in Table 42. Combination between GLV-1h68 and Avastin or Gemcitabine exhibited a significant synergistic effect as compared to GLV-1h68, Avastin or Gemcitabine alone.

TABLE 41

Median tumor volumes at different time points after i.v. injection of different modified viruses into nude mice bearing MIA-PaCa-2 tumors with or without Gemcitabine combination therapy

| Days post-implantation of tumor cells | Median tumor volume (mm$^3$) | | | | | | | |
|---|---|---|---|---|---|---|---|---|
| | No Treatment | GLV-1h68 | GLV-1h90 | GLV-1h96 | Gemcitabine | GLV-1h68 + Gemcitabine | GLV-1h90 + Gemcitabine | GLV-1h96 + Gemcitabine |
| 30 | 904.8 | 761.1 | 625.55 | 527.4 | 706.7 | 597.8 | 633.6 | 739.2 |
| 36 | 1806.4 | 1482.15 | 1067.85 | 1243.05 | 1556.2 | 1390.8 | 1209.15 | 1413.6 |
| 45 | 4641.7 | 1223.1 | 1233.8 | 1154.3 | 3184.35 | 1209 | 1315.45 | 1593.4 |
| 52 | * | 1175.85 | 853.55 | 736.45 | 4187.45 | 854.4 | 995.5 | 1049.4 |
| 58 | * | 1073.15 | 681.95 | 546.05 | * | 766.6 | 825.65 | 981.35 |

TABLE 40

Body weight change at different time points after i.v. injection of GLV-1h68 into nude mice bearing PANC-1 tumors with or without Erbitux or Avastin combination therapy

| Days post-implantation of tumor cells | Body weight Change (%) | | | | | |
|---|---|---|---|---|---|---|
| | No Treatment | GLV-1h68 | GLV-1h68 + Erbitux | Erbitux | GLV-1h68 + Avastin | Avastin |
| 26 | 0 | 0 | 0 | 0 | 0 | 0 |
| 33 | −0.36 | −2.4 | −3.1 | −0.19 | −4.41 | −1.14 |
| 41 | 0 | −6.85 | −5.43 | 0.38 | −4.41 | −3.6 |
| 49 | −2.91 | −2.78 | 1.55 | −2.66 | 2.61 | −2.65 |
| 56 | 1.09 | 7.04 | 9.88 | −1.52 | 14.63 | −6.06 |
| 68 | −3.27 | 11.11 | 14.53 | −5.69 | 19.84 | −5.49 |
| 76 | −3.27 | 11.3 | 13.76 | −3.04 | 19.44 | −7.95 |
| 85 | −6.18 | 13.7 | 17.25 | −4.36 | 19.44 | −8.9 |

Example 23

Effect of Combination Therapy on Pancreatic Tumor Growth In Vivo

A. Combination Therapy with IL-6 or IL-24-Expressing Viruses and Gemcitabine

Tumors were established in nude mice by subcutaneously injecting 5×10$^6$ cells MIA PaCa-2 human pancreatic carci- B. Comparison of Combination Therapy with Gemcitabine or Avastin Tumors were established in nude mice by subcutaneously injecting 5×10$^6$ cells GI-101A human breast carcinoma cells (Rumbaugh-Goodwin Institute for Cancer Research Inc. Plantation, Fla.; U.S. Pat. No. 5,693,533) subcutaneously on the right lateral thigh of female nude mice (Hsd:Athymic Nude-Foxn1$^{nu}$; Harlan, Indianapolis, Ind.; n=4-8mice/group). Following tumor cell implantation, one group of mice was injected with 5×10$^6$ PFU/mouse of GLV-1h68 virus in the femoral vein at 23 days post-cancer cell injection, one group of mice was intraperitoneally injected with 80 mg/kg irinotecan once a week on each of days 36, 43, 50 and 59 post-cancer cell injection, and one group received combination therapy of GLV-1h68 and irinotecan (irinotecan injected at same time points as the last group). Tumor volume (mm$^3$) was measured at days 22, 32, 36, 42, 49, 59, 66, 80, 86, 99, 108, and 116 post-cancer cell injection. Results are provided in Table 43. Combination between GLV-1h68 and irinotecan exhibited a significant synergistic effect as compared to GLV-1h68 or irinotecan alone.

TABLE 42

Median tumor volumes at different time points after i.v. injection of GLV-1h68 into nude mice bearing MIA-PaCa-2 tumors with or without Gemcitabine or Avastin combination therapy

| Days post-implantation of tumor cells | Median tumor volume (mm³) | | | | |
|---|---|---|---|---|---|
| | No Treatment | GLV-1h68 | Avastin | GLV-1h68 + Avastin | Gemcitabine | GLV-1h68 + Gemcitabine |
| 30 | 904.8 | 761.1 | 645.65 | 824.5 | 706.7 | 597.8 |
| 36 | 1806.4 | 1482.15 | 1408.4 | 1325.6 | 1556.2 | 1390.8 |
| 45 | 4641.7 | 1223.1 | 2746.25 | 1422.45 | 3184.35 | 1209 |
| 52 | * | 1175.85 | 4241.15 | 842.05 | 4187.45 | 854.4 |
| 58 | * | 1073.15 | * | 697.9 | * | 766.6 |

Example 24

Effect of Irinotecan Combination Therapy on Breast Tumor Growth In Vivo

Tumors were established in nude mice by subcutaneously injecting 5×10⁶ cells GI-101A human breast carcinoma cells (Rumbaugh-Goodwin Institute for Cancer Research Inc. Plantation, Fla.; U.S. Pat. No. 5,693,533] subcutaneously on the right lateral thigh of female nude mice (Hsd:Athymic Nude-Foxn1$^{nu}$; Harlan, Indianapolis, Ind.; n=4-8 mice/group). Following tumor cell implantation, one group of mice was injected with 5×10⁶ PFU/mouse of GLV-1h68 virus in the femoral vein at 23 days post-cancer cell injection, one group of mice was intraperitoneally injected with 80 mg/kg irinotecan once a week on each of days 36, 43, 50 and 59 post-cancer cell injection, and one group received combination therapy of GLV-1h68 and irinotecan (irinotecan injected at same time points as the last group). Tumor volume (mm³) was measured at days 22, 32, 36, 42, 49, 59, 66, 80, 86, 99, 108, and 116 post-cancer cell injection. Results are provided in Table 43. Combination between 1h68 and irinotecan exhibited a significant synergistic effect as compared GLV-1h68 or irinotecan alone.

TABLE 43

Median tumor volumes at different time points after i.v. injection of GLV-1h68 into nude mice bearing GI-101A tumors with or without Irinotecan combination therapy

| Days post-implantation of tumor cells | Median tumor volume (mm³) | | | |
|---|---|---|---|---|
| | No Treatment | GLV-1h68 | Irinotecan | GLV-1h68 + Irinotecan |
| 22 | 244.5 | 166 | 184 | 219.45 |
| 32 | 594.9 | 604.3 | 458.45 | 546 |
| 36 | 695.85 | 649.3 | 546.2 | 734.55 |
| 42 | 951.55 | 1002 | 668.75 | 921.25 |
| 49 | 1261.05 | 1200.8 | 712.9 | 973.35 |
| 59 | 1844.7 | 1694 | 831.8 | 901.55 |
| 66 | nd | 2049.2 | 1011.8 | 1003.25 |
| 80 | nd | 2608.4 | 1502.15 | 817.45 |
| 86 | nd | 2296.8 | 1678.4 | 684.8 |
| 99 | nd | 1647.5 | 2712.55 | 526.15 |
| 108 | nd | nd | nd | 429.25 |
| 116 | nd | nd | nd | 337.65 |

Example 25

Expression of Anti-VEGF Single Chain Antibody by Modified Vaccinia Strains

A. Expression of G6-FLAG in CV-1 Cells

Monkey CV-1 cells were infected with the GLV-1h107, GLV-1h108 and GLV-1h109 virus strains and expression of G6-FLAG was investigated via Western blot analysis. For negative controls, uninfected cells or cells infected with GLV-1h68, which lacks the G6-FLAG gene, were used. At 48 h post-infection, the supernatant of the infected cells was collected and cell pellets were harvested. The supernatant samples were centrifuged to remove cellular debris. Protein fractions were denatured and separated via vertical SDS-PAGE (sodium-dodecyl-sulfate polyacrylamide gel electrophoresis). Proteins were transferred to a PVDF-membrane and nonspecific binding was blocked by incubation of the membrane in 1×PBS/5% skim milk. The membrane was then incubated with the specific antibody rabbit anti-DDDDK-tag (detects the FLAG-tag) overnight. Chromogenic detection was achieved using a secondary HRP-conjugated goat anti-rabbit-IgG and an HRP detection kit, Opti4CN (4-chloro-1-naphthol; Bio-Rad). Expressed scAb G6-FLAG protein (approximate size 32 kDa) was detected both in the supernatant and the pellet (intracellular protein) for all three strains. Both GLV-1h108 ($P_{SEL}$) and GLV-1h109 ($P_{SL}$) strains exhibit high levels of expression of G6-FLAG after 48 h post-infection due to the stronger $P_{SEL}$ and $P_{SL}$ promoters in the 1h108 and 1h109 strains, respectively. Strain GLV-1h107 ($P_{SE}$) exhibits a lower expression of G6-FLAG as compared to GLV-1h108 and GLV-1h109 due the weaker $P_{SE}$ promoter in the GLV-1h107 strain. The experiment shows that the recombinant DNA can be delivered to mammalian cells via viral delivery by the modified vaccinia strains. The recombinant protein is successfully expressed in the infected cell and is secreted into the surrounding medium.

During the course of virus replication, infected cells undergo apoptosis and die. The cell membrane is also destroyed and cellular proteins are released into the supernatant. In order to demonstrate that the protein in the collected supernatants was a result of secretion by the infected cells and not by release of proteins into the supernatant by dying or dead cells, supernatant was harvested from infected CV-1 cells at 6 h post-infection and analyzed by Western blot detection. Since cell death is minimal at earlier time points during infection, analyzing the supernatant from the infected cells at 6 h post-infection allows detection of proteins that are actively secreted into the supernatant. By Western blot analysis, expression at 6 h post-infection was low but detectable in the cell supernatants, indicating that the G6-FLAG fusion protein is expressed and secreted by the cells into the surrounding media B. Expression of G6-FLAG in Tumor Cell Lines Different tumor cell lines were infected with an MOI of 10 (GLV-1h107 to GLV-1h109; GLV-1h68 as a control). The used cell lines included breast tumor (GI-101A), prostate adenocarcinoma (PC-3), colon carcinoma (HT-29) and pancreatic cancer (PANC-1) cell lines. After 48 h post-infection, the supernatant of the infected cells was collected and cell pellets were harvested. The supernatant samples were centrifuged to remove cellular debris. Western blot analysis was performed as described in (A). The expressed scAb G6-FLAG (approximate size 32 kDa) was detected after 48 h for all strains tested. Both GLV-1h108 ($P_{SEL}$) and GLV1h109 ($P_{SL}$) strains exhibited higher levels of expression of G6-FLAG as compared to strain GLV-1h107 ($P_{SE}$). The supernatant protein fractions contain a higher amount of protein compared to pellet protein fractions.

Example 26

Functional In Vitro Analysis of Expressed G6-FLAG by ELISA

In order to investigate the functional properties of the scAb G6-FLAG, CV-1 cells were infected with virus strains GLV-1h107, GLV-1h108 and GLV-1h109, and the binding of expressed G6-FLAG, collected from cell supernatants, to human VEGF protein was analyzed by Enzyme-Linked ImmunoSorbent Assay (ELISA). Uninfected CV-1 cells and CV-1 cells infected with GLV-1h68 were employed as negative controls. Microtiter plates were pre-incubated with human VEGF (Sigma) at a concentration of 1.8 µg/ml at 4° C. overnight. Supernatant of CV-1 infected cells was sampled after 48 h and centrifuged to remove cellular debris. The supernatant was then serially diluted and incubated at room temperature on the pre-coated microtiter plates. To detect functional binding, rabbit anti-DDDDK-tag and HRP-conjugated goat anti-rabbit-IgG antibodies were serially used. Chromogenic detection was achieved by using TMB 3,3',5, 5'-tetramethylbenzidine, Sigma), and the reaction was stopped with 2N hydrochloric acid. The blue color development was measured using a microtiter plate reader (Molecular Devices).

The supernatants of cells infected with the GLV-1h107, GLV-1h108, and GLV-1h109 viruses contained functional G6-FLAG protein that bound to the VEGF-coated plates (Table 44). The concentration of G6-FLAG in the supernatants of the GLV-1h108 or GLV-1h109 infected cells was higher as compared to the GLV-1h107 infected cells. In the GLV-1h108 or GLV-1h109 samples, the supernatants needed to be diluted at least by a factor of 50 to achieve unsaturated detection. The controls of uninfected and GLV-1h68 infected cells show marginal or no binding affinity to the human VEGF-coated plate.

Example 27

Functional In Vitro Analysis of Anti-Angiogenic Activity

The anti-angiogenic effects of virally expressed scAb G6-FLAG can be studied in an in vitro model of angiogenesis. The murine endothelial cell line 2h11 (ATCC No. CRL-2163) can be employed in order to study inhibitory effects of the scAb G6-FLAG on tube formation in vitro. For the tube formation assays, the cells are trypsinized, counted and diluted to a concentration of about $1 \times 10^5$ cells/ml. Human VEGF (Sigma) is added to the cells (end concentration 40 ng/ml) and mixed. CV-1 cells are separately infected with GLV-1h107, GLV-1h108 or GLV-1h109 (scAb G6-FLAG-expressing viruses) or control strain GLV-1h68. The supernatant of infected CV-1 cells is harvested and centrifuged in order to remove cellular debris. Several different volumes of the CV-1 cell supernatant are then added to the samples of 2h11 endothelial cells. After a 5-10 min incubation, the suspension is added to the wells of a microtiter plate (24-well; 500 µl/well) containing a layer of Matrigel™ (BD Biosciences; other matrices can also be employed to induce tube formation, for example, fibrin gels or gelatin matrices). Tube formation is monitored with a microscope over time (approx. 24 h). The following controls can be used: 1) cells incubated without addition of VEGF (negative control); 2) cells incubated with VEGF alone; or 3) cells incubated with VEGF and different concentrations of Avastin® (positive control). The latter control mimics the mode of action of the scAb G6-FLAG by binding VEGF and sequestering it away from its receptor on the endothelial cells.

Example 28

Purification of G6-FLAG from Supernatants of Virus Infected Cells

The virally expressed G6-FLAG protein can be purified for further analytical studies in order to reduce background activity of other factors present in the supernatant samples collected from virus infected cells. The scAb G6-FLAG protein was immunoprecipitated via the FLAG-tag using Sigma FLAG®-Tagged Protein Immunoprecipitation Kit according to the manufacturer's recommendations. FLAG-tagged proteins were bound by an antibody, which is bound to an agarose resin. Following binding and washing off unbound supernatant proteins, the G6-FLAG protein was eluted from the resin by competitive binding with a short FLAG peptide. The isolated G6-FLAG can be kept in a native condition following purification.

TABLE 44

Analysis of functional binding of scAb G6-FLAG to human VEGF via ELISA

| | Absorbance $OD_{450}$ | | | | |
|---|---|---|---|---|---|
| Dilution | GLV1h107 | GLV1h108 | GLV1h109 | Uninfected CV-1 | GLV1h68 |
| 1:200 | 0.0908 | 0.7637 | 0.8728 | 0.2330 | 0.1033 |
| 1:100 | 0.1363 | 1.0060 | 1.0220 | 0.0737 | −0.0534 |
| 1:50 | 0.3209 | 1.3736 | 1.2368 | −0.0498 | −0.0097 |
| 1:20 | 0.5558 | 1.9924 | 1.8959 | −0.0006 | 0.0119 |
| 1:10 | 0.9059 | 1.6135 | 1.8163 | 0.00607 | 0.0124 |
| 1:5 | 1.4289 | 2.0801 | 1.8982 | −0.0012 | 0.0295 |
| 1:2 | 1.8765 | 2.0439 | 1.9194 | 0.00807 | 0.1445 |

The purified proteins were analyzed by Western blot detection and ELISA assays. G6-FLAG protein (32 kDa) was detected in the GLV-1h107, GLV-1h108 and GLV-1h109 samples. FLAG-BAP Fusion Protein (55 kDa; Sigma) was employed as a positive control for the protein detection. No G6-FLAG protein was present in supernatant from control GLV-1h68 infected cells or in the PBS control. The functionality of the purified G6-FLAG protein was analysed by ELISA assay (Table 45). The G6-FLAG protein isolated from the GLV-1h107, GLV-1h108 and GLV-1h109 samples all exhibited functional binding of human VEGF. The sample derived from GLV-1h108 and GLV-1h109 infected CV-1 cells exhibited a higher absorbance as compared GLV-1h107 infected CV-1 cells due to higher amounts of protein in the starting sample. This Western blot analysis showed a similar relative amounts of G6-FLAG in the GLV-1h108 and GLV-1h109 versus GLV-1h107 derived samples.

TABLE 45

Analysis of functional binding of purified scAb G6-FLAG to human VEGF via ELISA

| Dilution | Absorbance $OD_{450}$ | | | |
|---|---|---|---|---|
| | GLV1h107 | GLV1h108 | GLV1h109 | GLV1h68 |
| 1:10 | .2644 | 1.946 | 1.1976 | −0.0106 |
| 1:50 | 0.0574 | 0.8853 | 1.0877 | −0.0093 |
| 1:100 | 0.0167 | 0.6854 | 0.8257 | 0.0185 |
| 1:200 | 0.0111 | 0.4084 | 0.5142 | 0.006 |
| 1:500 | 0.0021 | 0.1911 | 0.3093 | 0.0067 |

Example 29

Effects of scAb anti-VEGF Expressing Viruses on Breast Tumor Growth In Vivo

The in vivo effects of virally expressed G6-FLAG protein on tumor growth were evaluated in a mouse model of breast cancer. The human breast cancer cell line GI-101A was used as a xenograft tumor model in nude mice. The in vivo effects of G6-FLAG expressing viruses GLV-1h107, GLV-1h108 and GLV-1h109 on tumor growth were compared to virus strains GLV-1h68 and GLV-1h72.

Tumors were established in nude mice by subcutaneously injecting GI-101A human breast carcinoma cells (s.c. on the right lateral thigh; $5 \times 10^6$ cells; GI-101A cells: Rumbaugh-Goodwin Institute for Cancer Research Inc. Plantation, Fla.; U.S. Pat. No. 5,693,533) into four- to five-week-old female nude mice (Hsd: Athymic Nude-Foxn1$^{nu}$; Harlan, Indianapolis, Ind.) (n=4-5 per group). Twenty-three days following tumor cell implantation (approximate tumor volume 250 mm$^3$), the groups of mice were injected intravenously [in 100 µl of PBS, through femoral vein under anesthesia] with $5 \times 10^6$ PFU of GLV-1h68, GLV-1h72, GLV-1h107, GLV-1h108 and GLV-1h109. Tumor dimensions (mm) were measured using a digital caliper, and tumor volume (mm$^3$) was calculated according to the formula: (height-5)×width×length)/2. The net body weight change over time was determined by weighing mice and subtracting the estimated tumor weight (1000 mm$^3$=1 g) (Table 46). Net body weight change was calculated by the following formula: [(Gross weight−tumor weight)−(gross weight at T23−tumor weight at T23)]/(gross weight at T23−tumor weight at T23); "T23" means 23 days after tumor cell implantation, which was also the time of virus injection. The survival rate of mice treated with the different virus strains was monitored throughout the experiment.

Table 46 shows the median GI-101A tumor volume over time after virus injection. In the untreated control mice, exponential tumor growth was observed. Mice were killed after tumor growth exceeded 2500 mm$^3$ (58 days after tumor implantation). In the GLV-1h68 treated mice, the tumor growth shows the typical three-phase growth pattern (Zhang et al. (2007) Cancer Research 67:20). During Phase I (growth phase), the tumor volume exceeds that of the untreated control group. The tumor growth then slows and arrests approximately 30 days following virus injection (inhibitory phase, Phase II). After an additional 10 days the inhibitory phase is followed by the regression phase (Phase III) where the tumor volume decreases over time until the termination of the experiment at 100 days following tumor cell implantation. Mice infected with the virus strain GLV-1h72 show a different tumor growth pattern than GLV-1h68, which is characterized by a delayed onset of tumor growth with no apparent Phase I and a lower median tumor size in Phase II. The tumor regression rate (in Phase III) in GLV-1h72 treated mice is slower than in GLV-1h68 treated mice. The GLV-1h72 virus strain also is slightly more toxic in vivo than GLV-1h68 based on net body weight changes in nude mice after virus treatment (Table 47). Tumors in mice treated with the GLV-1h107 virus strain show a growth pattern similar to GLV-1h72 treated tumors with a delayed onset of tumor growth of a week compared to GLV-1h68 and an overall lower tumor size than in the GLV-1h68 treated group (Table 46). Forty-two days after virus injection, the regression phase starts with a rapid decrease of tumor volumes. After a week the tumor volumes reach a plateau. Due to the lower survival rate in this group, the number of mice fell below the statistically evaluable number. All mice in the group were killed one week before the endpoint of the experiment. Further outcome of tumor growth could not be monitored throughout this experiment. Toxicity studies as determined by net body weight change indicate that this virus strain can be more toxic than GLV-1h68, since the mice do not show significant weight gain over the course of the experiment (Table 47).

In mice treated with GLV-1h108, a more pronounced inhibition of tumor growth can be seen compared to GLV-1h68. Tumor growth was inhibited very early after injection and does not reach comparable tumor sizes as in GLV-1h68 treated mice in the inhibitory phase. Over the course of therapy, tumor sizes in GLV-1h 108 treated mice are lower than in GLV-1h72 treated mice. The regression phase is characterized by a slower tumor volume decrease than in GLV-1h68 treated animals. At the endpoint of the experiment, median tumor volumes of the mice are similar to those of GLV-1h68 and GLV-1h72 treated mice.

The infection of tumor bearing mice with GLV-1h109 leads to a slower tumor growth as described for GLV-1h108 treated tumors, but the tumor growth pattern does not resemble the above described three phase pattern. In contrast, the growth of the tumors in these mice can be divided into regression and progression phases of tumor growth. After a third regression phase, tumors start to grow again until the termination of the experiment.

Based on net body weight change data, both GLV-1h108 and GLV-1h109 viral strains show a slightly increased toxicity as compared to GLV-1h68. This correlates with a survival rate of 80% in GLV-1h108 and GLV-1h109 treated mice, as compared to a survival rate of 100% in GLV-1h68 treated animals.

The results of the tumor therapy experiment show that treatment of nude mice bearing GI-101A tumors with the GLV-1h107, GLV-1h108 and GLV-1h109 virus strains all lead to a marked regression or delay of tumor growth in vivo.

The varying ability of the GLV-1h107, GLV-1h108 and GLV-1h109 virus strains to mediate tumor growth inhibition in vivo correlates with the strength of the different promoters used to express the G6-FLAG gene. GLV-1h107 comprises the weakest promoter for the G6-FLAG expression, whereas GLV-1h108 and GLV-1h109 both contain the stronger late promoters and show increased expression of G6-FLAG in vitro.

TABLE 46

Median tumor volumes at different time points after i.v. injection of G6-FLAG-expressing viruses into nude mice bearing GI-101A tumors

| Days post-implantation of tumor cells | Median tumor volume (mm3) | | | | | |
|---|---|---|---|---|---|---|
| | No treatment (PBS) | GLV 1h68 | GLV 1h72 | GLV 1h107 | GLV 1h108 | GLV 1h109 |
| 21 | 241.46 | 212.1975 | 225.51 | 218.655 | 118.3955 | 98.4175 |
| 23 | 294.75 | 277.49 | 257.155 | 265.88 | 238.365 | 284.605 |
| 27 | 367.385 | 384.88 | 317.36 | 349.455 | 383.8 | 358.3 |
| 30 | 427.9 | 573.31 | 433.37 | 430.605 | 424.335 | 444.54 |
| 34 | 729.68 | 946.35 | 628.875 | 627.96 | 616.6 | 599.775 |
| 41 | 965.51 | 1098.17 | 1020.31 | 959.9 | 721.145 | 887.13 |
| 43 | 934.735 | 1229.04 | 981.53 | 985.135 | 767.175 | 678.125 |
| 48 | 1167.225 | 1416.89 | 1027.41 | 1109.095 | 925.975 | 739.355 |
| 51 | 1502.02 | 1664.53 | 1101.01 | 1032.565 | 911.125 | 793.465 |
| 55 | 2121.975 | 1652.39 | 1078.65 | 1183.955 | 984.175 | 1006.535 |
| 58 | 2578.15 | 1564.61 | 1004.88 | 1162.59 | 826.3 | 805.38 |
| 65 | | 1353.9 | 1086.465 | 1094.915 | 795.92 | 683.36 |
| 72 | | 1328.66 | 1043.175 | 747.63 | 745.995 | 968.455 |
| 79 | | 1003.35 | 956.08 | 796.26 | 661.61 | 734.575 |
| 87 | | 851.52 | 970.815 | 748.61 | 639.15 | 900.045 |
| 93 | | 695.89 | 634.21 | 796.23 | 627.525 | 1108.115 |
| 100 | | 452.82 | 464.01 | | 436.38 | 1108.085 |

TABLE 47

Net animal body weight change (%) during the therapy of GI-101A tumors with G6-FLAG-expressing virus strains

| Days post-implantation of tumor cells | Mean weight change in % | | | | | |
|---|---|---|---|---|---|---|
| | No treatment (PBS) | GLV 1h68 | GLV 1h72 | GLV 1h107 | GLV 1h108 | GLV 1h109 |
| 0 | 0 | 0 | 0 | 0 | 0 | 0 |
| 4 | 4.7 | 3.8 | 4.2 | 4.3 | 1.6 | 1 |
| 7 | 6.3 | 1.3 | 6 | 5.7 | 0.9 | 2.7 |
| 11 | 6.8 | 3.7 | 4.8 | 4.4 | −0.5 | 3.7 |
| 18 | 3 | 6 | 7.1 | 1.9 | 0.7 | 0.2 |
| 21 | 8.3 | 5.9 | 12.3 | 4.8 | −0.1 | −3.9 |
| 25 | 13 | 12.2 | 13.1 | 7.4 | 4.1 | 4.9 |
| 28 | 12 | 14.6 | 9.3 | 6.1 | 1.7 | 6.4 |
| 32 | 8.2 | 13.8 | 14.6 | 6.2 | 5.1 | 6.1 |
| 35 | 11.1 | 15.5 | 12.2 | 5.5 | 8.4 | 11 |
| 38 | 13 | 14.1 | 13 | 8.2 | 9.6 | 11.5 |
| 42 | | 16.1 | 6.8 | 4.8 | 11.3 | 11.4 |
| 49 | | 16.3 | 12.6 | 5 | 10 | 9.4 |
| 56 | | 18.8 | 14.1 | 2.6 | 12.1 | 10.4 |
| 63 | | 20.6 | 4.8 | 9.3 | 15.7 | 13.9 |
| 70 | | 22.5 | 15.5 | 2.3 | 16.3 | 13.8 |
| 77 | | 23.3 | 10.5 | | 14.8 | 10.9 |

The survival rate of mice treated with the different viruses was monitored for 100 days after the implantation of the tumor cells (77 days after injection of the viruses). All of the mice that were treated with GLV1h68 survived throughout the monitoring period. All off the mice treated with GLV1h107 survived until day 60 post implantation, at which point one mouse died. Another mouse in this group died at day 80, reducing the final survival rate to 60%. Of the mice that received GLV1h108, only one died (day 80 post implantation) resulting in a survival rate of 80%. An 80% survival rate also was observed in the group of mice that were treated with GLV1h109, with one mouse dying 50 days post transplantation.

Example 30

Effects of scAb Anti-VEGF Expressing Viruses on Pancreatic Tumor Growth In Vivo

The in vivo effects of virally expressed G6-FLAG protein on tumor growth was evaluated in a mouse model of human pancreatic cancer. Tumors were established in nude mice by subcutaneously injecting $5\times10^6$ cells MIA PaCa-2 human pancreatic carcinoma cells (ATCC No. CRL-1420) subcutaneously on right lateral thigh of male nude mice (Hsd:Athymic Nude-Foxn1$^{nu}$; Harlan, Indianapolis, Ind.; n=3-8 mice/group). Twenty-nine days following tumor cell implantation, groups of mice were injected intravenously [in 100 μl of PBS, through femoral vein under anesthesia] with $5\times10^6$ PFU of GLV-1h68, GLV-1h107 and GLV-1h109, respectively. The control group of mice was not given any treatment. Tumor volume (mm$^3$) was measured at 30, 36, 45, 52 and 58 days post-cancer cell injection. Results of median tumor volume (mm$^3$) are provided in Table 48.

GLV-1h109 exhibited the best antitumor efficacy, resulting in tumors that were 27% the volume of those seen in mice treated with GLV-1h68. GLV-1h109 also exhibited good antitumor activity, reducing the growth of tumors to half that seen in mice treated with GLV-1h68.

TABLE 48

Median tumor volumes at different time points after i.v. injection of different virus strains into nude mice bearing MIA-PaCa-2 tumors

| Days post-implantation of tumor cells | Median tumor volume (mm³) | | | |
|---|---|---|---|---|
| | No Treatment | GLV-1h68 | GLV-1h107 | GLV-1h109 |
| 30 | 904.8 | 761.1 | 711.7 | 565.6 |
| 36 | 1806.4 | 1482.15 | 1410.2 | 1170 |
| 45 | 4641.7 | 1223.1 | 1453.9 | 832 |
| 52 | * | 1175.85 | 1098.7 | 611.7 |
| 58 | * | 1073.15 | 927.7 | 568 |
| 69 | * | 942.55 | 709.25 | 487.9 |
| 80 | * | 1200.1 | 721.8 | 455.3 |
| 92 | * | 1720.15 | 850.45 | 471.6 |

Example 31

Effects of IL-6 and IL-24 Expressing Viruses on Human Melanoma Growth In Vivo Systemic virotherapy of human melanoma tumors in mice was assessed using three different human melanoma cells to establish tumors, and different viruses for treatment. Human 888-MEL cells, 1858-MEL cells or 1936-MEL cells (gift from Dr. F. Marincola at the National Institutes of Health, Bethesda, Md.; see e.g. Wang et al., (2006) J. Invest. Dermatol. 126:1372-1377) were implanted subcutaneously into the right lateral thigh of nude mice at a dose of $1 \times 10^6$ cells, $4 \times 10^6$ cells and $1 \times 10^6$ cells, respectively, in 100 µl PBS. GLV-1h68, GLV-1h90 or GLV-1h96 at a dose of $5 \times 10^6$ PFU in 100 µl PBS were injected i.v. into the femoral vein of mice when the tumor was established. This corresponded to injection of virus 51 days after implantation into mice bearing 888-MEL cells; 27 days after implantation into mice bearing 1858-MEL cells; and 72 days after implantation in mice bearing 1936-MEL cells. The control groups of mice was not given any treatment. Tumor volume (mm³) was measured at different time points post tumor cell injection. Results of median 888-MEL, 1858-MEL and 1936-MEL tumor volume are provided in Tables 49, 50 and 51, respectively.

Each virus provided for a decrease in median tumor volume, relative to uninfected control mice, in mice bearing 888-MEL tumors (Table 49). Mice that received no treatment were sacrificed due to excessively large tumors reaching a median volume of 2166.8 mm³ at 83 days post implantation. GLV-1h96, which expresses IL-24, exhibited the best tumor therapy efficacy with a median tumor volume that reached 843.1 mm³ 110 days after implantation. GLV-1h68, which does not express an interleukin, and GLV1h90, which expresses IL-6, exhibited similar tumor therapy efficacy. Median tumor volumes at 110 days post implantation were 1657.2 mm³ in mice treated with GLV-1h68, and 1829.4 mm³ in mice treated with GLV-1h90.

TABLE 49

Median tumor volumes at different time points after i.v. injection of different modified viruses into mice bearing 888-MEL tumors

| Days post-implantation of tumor cells | Median tumor volume (mm³) | | | |
|---|---|---|---|---|
| | No treatment | GLV-1h68 | GLV-1h90 | GLV-1h96 |
| 50 | 144.75 | 292.4 | 153.7 | 460 |
| 57 | 217 | 463.65 | 256.9 | 732.5 |
| 63 | 438.05 | 667.35 | 381.2 | 895.2 |
| 66 | 549.45 | 559.85 | 465.8 | 763.2 |
| 71 | 945.55 | 653.95 | 446.3 | 668.6 |
| 76 | 1438.4 | 712 | 510 | 657.2 |
| 83 | 2166.3 | 669 | 783.2 | 582.6 |
| 91 | * | 677.4 | 925 | 636.9 |
| 100 | * | 926.4 | 1055.7 | 698 |
| 105 | * | 1272.95 | 1318.9 | 698.9 |
| 111 | * | 1657.2 | 1829.4 | 843.1 |

The 1858-MEL tumors of mice treated with the different viruses were markedly smaller in volume relative to uninfected control mice (Table 50). GLV-1h96 again exhibited the best tumor therapy efficacy with a median tumor volume that reached only 130.3 mm³ 59 days after implantation, which is approximately 14% of the volume of tumors in untreated mice at the same time point. Treatment with GLV-1h68 also slowed tumor growth in mice, compared to untreated mice. By day 59, mice treated with GLV-1h68 had median tumor volumes of 182.4 mm³, compared to 900 mm³ in untreated mice. GLV-1h90 exhibited slightly less tumor therapy efficacy compared to the other viruses (median tumor volume of 245.65 mm³ at day 59), but still slowed tumor growth compared to no treatment.

TABLE 50

Median tumor volumes at different time points after i.v. injection of different modified viruses into mice bearing 1858-MEL tumors

| Days post-implantation of tumor cells | Median tumor volume (mm³) | | | |
|---|---|---|---|---|
| | No treatment | GLV-1h68 | GLV-1h90 | GLV-1h96 |
| 27 | 81.45 | 108.95 | 109.9 | 105.8 |
| 34 | 148.8 | 204 | 161.3 | 171.6 |
| 39 | 206.05 | 217.6 | 182.4 | 178.2 |
| 45 | 356.9 | 202.5 | 216.8 | 171.3 |
| 52 | 695.6 | 182.9 | 239.8 | 148.6 |
| 59 | 900 | 182.4 | 245.65 | 130.3 |

Tumor therapy efficacy of GLV-1h68 and GLV-1h96 also was assessed in mice bearing 1936-MEL tumors (Table 51). In this experiment, GLV-1h68 exhibited the best efficacy, slowing tumor growth by approximately 50% compared to that observed in untreated mice (median tumor volume of 1572.6 mm³ at day 118 compared to 3175 mm³). GLV-1h96 also exhibited some tumor therapy efficacy, resulting in median tumor volumes of 2878.4 mm³ in mice treated with this virus.

TABLE 51

Median tumor volumes at different time points after i.v. injection of different modified viruses into mice bearing 1936-MEL tumors

| Days post-implantation of tumor cells | Median tumor volume (mm³) | | |
|---|---|---|---|
| | No treatment | GLV-1h68 | GLV-1h96 |
| 72  | 477.7   | 399.1  | 650.95  |
| 80  | 581.7   | 745.8  | 854.9   |
| 85  | 725.1   | 876.7  | 1043.6  |
| 91  | 1024.3  | 1088.8 | 1147.3  |
| 100 | 1429    | 1209   | 1634.1  |
| 105 | 1918.15 | 1290.1 | 1934.95 |
| 111 | 2664.6  | 1425.9 | 2532.65 |
| 118 | 3175    | 1572.6 | 2878.4  |

Example 32

Effects of Different Doses of IL-6 and IL-24 Expressing Viruses on the Health of Mice The effects of different doses of virally expressed IL-6 and IL-24 on the health of mice was evaluated by assessing body weight. Groups of 4-5 week old C57BL/6 mice were injected intravenously [in 100 µl of PBS, through tail vein] with $5\times10^7$ PFU, $1\times10^8$ PFU or $2\times10^8$ PFU of GLV-1h68, GLV-1h90 (expressing IL-6) and GLV-1h96 (expressing IL-24), respectively. Body weight was measured at 30, 36, 45, 52 and 58 days post-cancer cell injection. Results of median body weight (gm) are provided in Table 52. None of the viruses appeared to have a detrimental affect on the body weight of the mice.

TABLE 52

Median body weight at different time points after i.v. injection of different modified viruses into mice

| Days post injection of virus | GLV-1h68 | | | GLV-1h90 | | | GLV-1h96 | | |
|---|---|---|---|---|---|---|---|---|---|
| | $5\times10^7$ | $1\times10^8$ | $2\times10^8$ | $5\times10^7$ | $1\times10^8$ | $2\times10^8$ | $5\times10^7$ | $1\times10^8$ | $2\times10^8$ |
| 0  | 17.1 | 17.6 | 17.3  | 16.6 | 16.75 | 16.4  | 16.5 | 16.65 | 15.8 |
| 6  | 18.4 | 19.4 | 18.75 | 18.5 | 17.95 | 18.6  | 17.8 | 17.85 | 18.2 |
| 14 | 19.3 | 19.4 | 19.4  | 19.8 | 19.2  | 19.25 | 18.4 | 18.25 | 19.3 |
| 21 | 20.4 | 20.5 | 21    | 21   | 20.45 | 20.85 | 20   | 19.25 | 20.4 |
| 28 | 21.3 | 21.1 | 21.75 | 20.8 | 21.65 | 21.8  | 20.5 | 20.1  | 21.7 |
| 42 | 22.4 | 22.2 | 22.05 | 21.6 | 21.55 | 22.55 | 21.1 | 21    | 22   |
| 59 | 24.3 | 23   | 23.7  | 22.2 | 22.25 | 23.1  |      | 21.8  | 24.3 |

Example 33

Infectivity of GLV-1h68 in Normal and Tumor Fibroblast Cells

The infectivity of GLV-1h68 in cultures of normal and tumor fibroblast cells was assessed and compared by microscopy and virus titration. Primary human dermal fibroblasts (hDF) were purchased from Cell Applications, Inc., and grown in Fibroblast Growth Medium (Cell Application, Inc., San Diego, Calif.). HT-1080 (pLEIN) cells were derived from HT-1080, a human fibrosarcoma cell line (CCL-121, ATCC) by transfection with a GFP-expressing plasmid. HT-1080 (pLEIN) cells were grown in DMEM (Mediatech, Inc., Herndon, Va.) with 10% fetal bovine serum (FBS; Mediatech, Inc., Herndon, Va.). hDF and HT-1080(pLEIN) cells (were seeded at $2\times10^5$ cells/well in 24-well plates were infected the following days with a series of 10-fold dilutions of GLV-1h68 in duplicate. Two days post infection the plaques were either visualized under a fluorescence microscope (Olympus 1×71) using a FITC filter or stained with 0.13% crystal violet to determine the viral titers in both cell lines. Both the size and number of the plaques in each cell line was assessed.

The infectivity of GLV-1h68 in human primary dermal fibroblast cells (hDF cells) was approximately 200 times lower than that observed in the human fibrosarcoma cell line (HT-1080 (pLEIN)). The virus titer from hDF cells was $8.5\times10^6 \pm 1.4\times10^6$ PFU, compared to $1.7\times10 \pm 3.5\times10^9$ PFU from HT-1080 (pLEIN) cells. GLV-1h68 also was observed to form smaller plaques in hDF cells compared to HT-1080(pLEIN) cells. These results reflect the selective nature of GLV-1h68 cells for tumor cells versus normal healthy cells.

Example 34

Effect of Attenuation of Viruses on Infectivity in Primary Fibroblast Cells

To investigate the effect of attenuation of viruses on their infectivity in non-tumor cells, viral growth curves of different viruses in a primary fibroblast cells were determined. Primary murine embryonic fibroblast (MEF) cells were cultured in 12-well plates to $1.1\times10^5$ cells/well and infected at a multiplicity of infection (MOI) of 0.01 with $1\times10^3$ PFU of LIVP, WR, GLV-1d27, GLV-1f65, GLV-1h68, GLV-1h71 and dark 8.1, respectively. After 1 hr at 37° C., the inoculum was aspirated and the cell monolayers were washed twice with 2 ml of DPBS (Mediatech, Inc., Herndon, Va.). Two ml of DMEM containing 2% fetal bovine serum (FBS) were added into each well. Three wells of cells from each virus infection were harvested at 24, 48 and 72 hours post infection. The harvested cells were subjected to three freeze-thaw cycles and sonicated three times for 1 minute at full power before the amount of virus in the lysates was determined by titration. The virus was titrated in CV-1 cells in duplicate. Results of the virus titer are provided in Table 53.

Both the LIVP and WR strains established an infection in the primary MEF cells and increased viral titers by 2 to 3 log over 72 hours. In contrast none of the attenuated viruses (GLV-1d27, GLV-1f65, GLV-1h68, GLV-1h71 or dark 8.1) could replicate in MEF cells, and by 72 hours, none of the attenuated viruses were detectable in cultures of primary murine embryonic fibroblasts. The loss of infectivity of GLV- 1h68 and its parental (GLV-1d27 and GLV-1f65) and derived viruses in non-tumor cells indicates that these viruses have reduced toxicity compared to LIVP. This data supports the observations that in vivo administration of these attenuated viruses does not result in viral replication throughout the body (see e.g. Example 3), but rather just in tumor cells, thereby reducing in vivo toxicity.

TABLE 53

Virus Replication in Primary Murine Embryonic Fibroblast (MEF) Cells

| Hours post infect. | Log Virus Titer (PFU/mL) | | | | | | |
|---|---|---|---|---|---|---|---|
| | LIVP | WR | GLV-1d27 | GLV-1f65 | GLV-1h68 | GLV-1h71 | dark 8.1 |
| 0 | 3.041 | 3.041 | 3.041 | 3.041 | 3.041 | 3.041 | 3.041 |
| 24 | 4.014 | 4.754 | 2.009 | 0.784 | 0.784 | 1.091 | 1.498 |
| 48 | 4.963 | 5.947 | 0.000 | 1.133 | 1.133 | 0.932 | 1.780 |
| 72 | 5.292 | 6.273 | 0.000 | 0.000 | 0.000 | 0.000 | 0.000 |

Example 35

Replication of GLV-1h68 in Cat and Dog Tumor Cells

To determine whether virotherapy with GLV-1h68 and its derivatives could be used to treat animals other than humans, the replicative ability of GLV-1h68 in dog and cat tumor cells was assessed.

A. Replication of GLV-1h68 in FC77.T Feline Fibrosarcoma Cells

The ability of GLV-1h68 to replicate in FC77.T feline fibrosarcoma cells in vitro was investigated. FC77.T feline fibro sarcoma cells (ATCC No. CRL-6105) were cultured in vitro, a process that results in two populations of cells: adherent cells and suspension cells in clusters. The culture was infected with $4 \times 10^6$ PFU of GLV-1h68 at an MOI of 0.01, and the infected cells were harvested at 24, 48 and 72 hours post infection. The amount of virus in cell lysates was determined by titration of the virus in CV-1 cells. The level of GLV-1h68 infection in the adherent and suspended cell populations also was monitored by detection of the fluorescent signal emitted by the virally-encoded GFP.

It was observed in the in vitro GLV-1h68 replication study that cells in suspension displayed green fluorescence, indicating GLV-1h68 replication in this cell population. In contrast, no fluorescence was observed in adherent cells. Viral titers in the cell lysates of FC77.T feline fibrosarcoma cells dropped from $4 \times 10^6$ PFU of GLV-1h68 to undetectable levels by 24 hours post infection, indicating that this virus does not replicate well in these particular feline fibrosarcoma cells.

B. Replication of GLV-1h68 in D17 Dog Osteosarcoma Cells

The ability of GLV-1h68 to replicate in D17 dog osteosarcoma cells (ATCC No. CCL-183) in vitro, was investigated and compared its replication in GI-101A human breast carcinoma cells. Both cell types were cultured in vitro and infected with $4 \times 10^6$ PFU of GLV-1h68 at an MOI of 0.01. The infected cells were harvested at 24, 48 and 72 hours post infection and the amount of virus in cell lysates was determined by titration in CV-1 cells. The level of GLV-1h68 infection in the two cell cultures also was monitored by detection of the fluorescent signal emitted by the virally-encoded GFP.

It was observed in the in vitro GLV-1h68 replication study that D17 dog osteosarcoma cells displayed green fluorescence, indicating GLV-1h68 replication in this cell population. Viral titration indicated that GLV-1h68 replication in D17 dog osteosarcoma cells was equally as efficient as that observed in GI-101A human breast carcinoma cells, reaching median log titers of 6.2 in D117 cells compared to 5.9 in GI-101A cells by 72 hours post infection.

These studies in cat and dog tumor cells indicate that GLV-1h68 can replicate in animal cells other than human cells, and, therefore, that GLV-1h68 and its derivatives have the potential to be used in virotherapy treatments in animals other than humans.

Example 36

Cellular Immunity to GLV-1h68 in Mice

The ability of GLV-1h68 to induce a cellular immune response in mice was investigated by evaluating the cytotoxic T cell (CTL) response in in vitro chromium release CTL assays. Preliminary development experiments (Experiments 1 through 4) using only a few mice each were performed to determine the appropriate conditions and parameters for a larger study (Experiment 5) involving more animals. A detailed description of the methods for the CTL assay used in these experiments is provided in section 5, below.

1. Experiment 1.

To determine the appropriate length of time for infection of target cells for the CTL assay, mice treated with $5 \times 10^6$ PFU of GLV-1h68 (n=3) on day 1 and 14, by intravenous injection through the tail vein, and untreated control mice (n=2), were sacrificed on day 21. The effector cell splenocytes were isolated from the spleens and were mixed with $1 \times 10^4$ MC57G target cells (ATCC No. CRL-2295) that had previously been infected with GLV-1h68 either for 2 hours (MOI of 5) with concurrent $^{51}$Cr labeling, or infected overnight (MOI of 5) followed by a 2 hour $^{51}$Cr labeling incubation. The ratios at which the effector and target cells were mixed for the CTL assay were 3:1, 10:1, 30:1 and 90:1, and the cells were incubated for 4 hours. Following incubation, the cells were washed and lysed and the supernatant was assayed for radioactivity (in counts per minute) using a scintillation counter. It was observed that the CTL response in mice treated twice with GLV-1h68 was stronger when the target cells were infected for 2 hours (approximately 45-60% specific lysis at an E:T ratio of 90:1) compared with overnight infection (approximately 25-35% specific lysis). Splenocytes from untreated mice showed negligible specific lysis. These data indicate that a 2 hour infection with an MOI of 5 is appropriate for use in subsequent experiments.

2. Experiment 2

To assess the effect of restimulation of effector cells in vitro, a portion of the splenocytes from the Experiment 1 were restimulated in vitro by the addition of GLV-1h68 at an MOI of 0.25 for 1 week before they were used in a CTL assay with MC57G target cells that had been infected for 2 hours with GLV1h68 at an MOI of 5 and labeled with $^{51}$Cr. The CTL response was greater when effector cells were used after a 1 week restimulation, compared to no restimulation. Effector cells from mice treated twice with GLV-1h68, and restimulated for 1 week in vitro exhibited 50-70% specific lysis at an E:T ratio of 30:1, compared to approximately 25% specific lysis using cells that had not been restimulated (from Experiment 1). The CTL response from effector cells from untreated mice that had been restimulated for 1 week in vitro also increased, reaching approximately 15% specific lysis at an E:T ratio of 30:1. Recovery of cells, however, was poor, which could render this method inappropriate for some studies.

3. Experiment 3

To determine the effect of a freeze-thaw cycle on splenocytes prior to use in the CTL assay, splenocytes isolated from mice treated once with GLV-1h68 were frozen immediately on isolation and stored frozen in liquid nitrogen vapor. The cells were then thawed and restimulated with GLV-1h68 at an MOI of 0.25 for 1 week before they were used as effectors in a CTL assay with MC57G target cells that had been infected for 2 hours with GLV1h68 at an MOI of 5 and labeled with $^{51}$Cr. Freezing of the splenocytes from GLV-1h68 treated mice resulted in specific lysis of up to 100% at an E:T ratio of 60:1. After thawing and 1 week of restimulation, however, no splenocytes were recovered from untreated animals. Thus, in vitro restimulation was not included in subsequent experiments.

4. Experiment 4

In a fourth preliminary experiment, splenocytes from animals treated either once or twice with GL-ONC1 isolated and subjected to a freeze thaw cycle prior to incubation in a CTL assay with MC57G target cells that had been infected with GLV-1h68 and labeled with $^{51}$Cr. The CTL response after a freeze-thaw cycle (and no in vitro restimulation) was greater in mice treated twice with GLV-1h68 (approximately 20% specific lysis at an E:T ratio of 60:1) compared to mice treated only once with GLV-1h68 (less that 5% specific lysis at an E:T ratio of 60:1). This data indicates that it may be more appropriate to test fresh instead of freeze-thawed splenocytes from animals treated once with GLV-1h68.

5. Experiment 5

Experiments 1-4 were used to establish appropriate conditions and parameters for the following larger study of the cellular immune response in mice treated with GLV-1h68. Ten 10 week old C57/BL6 mice (5 male and 5 female) were injected intravenously into the tail vein with $5 \times 10^6$ PFU of GLV-1h68 in 500 µl PBS. A control group of 10 C57/BL6 mice (5 male and 5 female) were treated with PBS alone. Twenty-one days after injection, the mice were sacrificed and the spleens were removed ascetically. The excess fat was trimmed off the spleens and the spleens were transferred to 5 ml tubes containing 2-3 ml sterile culture medium and stored on ice for transport.

To prepare the effector cells for the CTL assay, single cell suspensions of the mouse splenocytes were prepared before the cells were filtered through a 40-70 µm sterile cell strainer and centrifuged at 250-350×g for 8 to 10 mins at 15-20° C. The supernatant was aspirated and the cells were resuspended at $9 \times 10^6$ cells/ml in pre-warmed effector medium (RPMI-1640 with 10% heat inactivated FBS, 55 µM 2-mercaptoethanol, 1% GlutaMAX (Invitrogen, CA) and 1 mM sodium pyruvate). The cells were further diluted to $3 \times 10^6$ cells/ml, $1 \times 10^6$ cells/ml and $3 \times 10^5$ cells/ml.

To prepare the target cells for the CTL assay, $3 \times 10^5$ cells/ml MC57G cells (ATCC No. CRL-2295) were cultured in a tissue culture flask overnight in target medium (EMEM with 10% heat inactivated FBS, 100 µM non-essential amino acids, 1% GlutaMAX and 1 mM sodium pyruvate). A stock of $1 \times 10^8$ PFU/ml of GLV-1h68 was prepared in target medium, and a stock of 1 mCi/ml of $^{51}$Cr also was prepared. The MC57G cells were harvested and $1.5 \times 10^6$ cells were resuspended in 0.35 ml target medium in a 15 ml tube, to which was added 0.075 ml of $^{51}$Cr and 0.075 ml of GLV-1h68. Uninfected target cells also were prepared as controls by adding 0.075 ml of $^{51}$Cr and 0.075 ml of target medium (no virus). The target cells were then incubated for 2 hours at 37° C. Following incubation the cells were washed three times in effector medium and counted.

The CTL assay was initiated by adding $1 \times 10^4$ target cells (infected or uninfected) in 100 µl to the wells of a 96 well plate. An equal volume of effector cells were then added to each well such that the effector:target cell (E:T) ratios were 30:1, 90:1, 270:1 and 540:1. Additional controls to assess maximum lysis and spontaneous release of $^{51}$Cr were included in the assay by plating 100 µl target cells with 100 µl 2% lysis buffer (2% Triton X-100 in effector medium), and 100 µl target cells with 100 µl effector medium, respectively. A further positive control using pooled splenocytes (after a freeze-thaw cycle) from mice treated twice (on day 1 and day 14) with $5 \times 10^6$ PFU GLV-1h68 also was included, using E:T ratios of 3.3:1, 10:1, 30:1 and 90:1. The 96 well plates were centrifuged at 150×g for 5 minutes and then incubated at 37° C. for 4 hours. The plates were again centrifuged at 150×g for 5 minutes and 50 µl supernatant from each well was added to the corresponding well of a 96 well plate containing 150 µl scintillation fluid/well. The radioactivity (counts per minute (CPM)) was measured using a scintillation counter. The percentage specific lysis of target cells for each effector:target ratio are provided in Table 54. Statistical analysis of the data was performed using a t-test.

The mean percent specific lysis using effector cells from GLV-1h68 treated animals was greater than that of mice treated with PBS at each effector:target ratio (values ranged from 0.3% to 3.8% in controls and 2.1% to 6.4% in GLV-1h68 treated animals). A very strong CTL response was elicited in mouse 18, reaching levels approximately twice that of other mice administered GLV-1h68. Statistical analysis revealed that the increases in CTL response in mice that received a single GLV-1h68 injection compared to untreated mice were statistically significant at each effector:target ratio (probability value (p)=0.0016 for the E:T ratio of 30:1; p=0.0010 for the E:T ratio of 90:1; p=0.0021 for the E:T ratio of 270:1; and p=0.0315 for the E:T ratio of 540:1). When animal 18 (a putative outlier, discussed above) was excluded from analysis, mean percent specific lysis using effector cells from GLV-1h68 treated animals remained greater than that for cells from control animals, but the differences were statistically significant only at the 30:1, 90:1, and 270:1 effector:target ratio.

As shown in Table 54, there was more robust CTL activity using the positive control cells, which were obtained from mice treated twice with GLV-1h68. Percent specific lysis values in this cell population ranged from 5.0% (3.3:1 effector:target ratio) to 37.0% (90:1 effector:target ratio).

This data indicates that intravenous administration of GLV-1h68 to mice elicits a specific cytotoxic T cell response that can be readily detected using standard cellular immunity assays.

TABLE 54

Cytotoxic T cell activity in mice treated with GLV-1h68

| | | Percentage specific lysis | | | | |
|---|---|---|---|---|---|---|
| | | Infected target cells | | | | Uninfected target cells |
| Animal | Treatment | E:T 30:1 | E:T 90:1 | E:T 270:1 | E:T 540:1 | E:T 270:1 |
| 1 | PBS | 0.2% | 0.8% | 3.3% | 6.2% | 3.2% |
| 2 | PBS | 1.1% | 1.1% | 3.8% | 5.9% | 2.6% |
| 3 | PBS | 0.9% | 0.7% | 2.2% | 4.2% | 1.4% |
| 4 | PBS | 0.6% | 1.6% | 3.3% | 4.8% | 1.6% |
| 5 | PBS | 0.5% | 0.5% | 2.2% | 4.1% | 1.3% |
| 6 | PBS | 0.0% | 1.2% | 3.0% | 4.8% | 1.9% |
| 7 | PBS | 0.7% | 0.9% | 3.1% | 4.5% | 2.8% |

TABLE 54-continued

Cytotoxic T cell activity in mice treated with GLV-1h68

| | | | | | | |
|---|---|---|---|---|---|---|
| 8 | PBS | 1.0% | −0.1% | 0.4% | 0.8% | 2.3% |
| 9 | PBS | −0.9% | −0.1% | 1.4% | 1.0% | 2.6% |
| 10 | PBS | −0.9% | −0.3% | 1.3% | 1.3% | 1.2% |
| | Group mean | 0.3% | 0.6% | 2.4% | 3.8% | 2.1% |
| | Standard deviation | 0.7% | 0.6% | 1.1% | 2.0% | 0.7% |
| 11 | GLV-1h68 | 0.3% | 1.1% | 2.9% | 3.2% | 1.8% |
| 12 | GLV-1h68 | 0.8% | 3.1% | 4.5% | 4.7% | 1.9% |
| 13 | GLV-1h68 | 2.2% | 3.1% | 5.2% | 4.2% | 3.5% |
| 14 | GLV-1h68 | 1.3% | 2.9% | 8.0% | 8.3% | 2.5% |
| 15 | GLV-1h68 | 1.5% | 4.5% | 5.5% | 6.5% | 2.6% |
| 16 | GLV-1h68 | 2.0% | 3.2% | 4.3% | 4.4% | 1.9% |
| 17 | GLV-1h68 | 2.9% | 4.8% | 7.6% | 7.1% | 2.7% |
| 18 | GLV-1h68 | 5.1% | 11.3% | 14.6% | 11.7% | 3.5% |
| 19 | GLV-1h68 | 2.3% | 2.6% | 4.0% | 4.1% | 1.7% |
| 20 | GLV-1h68 | 2.6% | 4.6% | 7.1% | 7.5% | 2.6% |
| | Group mean$^a$ | 2.1% | 4.1% | 6.4% | 6.2% | 2.5% |
| | Standard deviation$^a$ | 1.3% | 2.8% | 3.3% | 2.6% | 0.6% |
| | Group mean$^b$ | 1.8% | 3.3% | 5.5% | 5.6% | 2.4% |
| | Standard deviation$^b$ | 0.8% | 1.2% | 1.8% | 1.8% | 0.6% |

| | E:T 3.3:1 | E:T 10:1 | E:T 30:1 | E:T 90:1 | E:T 290:1 |
|---|---|---|---|---|---|
| Positive control | 5.0% | 9.8% | 20.0% | 37.0% | 1.9% |

$^a$Including all animals (11-20).
$^b$Excluding animal 18.
$^c$Pooled splenocytes (after freeze-thaw cycle) from animals treated twice with GL-ONC1.

Since modifications will be apparent to those of skill in this art, it is intended that this invention be limited only by the scope of the appended claims.

SEQUENCE LISTING (118 sequences)

SEQ ID NO: 1 - DNA, 203057 bp, Vaccinia virus
  GLV-1h68
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggtggtggtgcaaatcaaagaactgctcctcagtggatgttgcctttacttctaggcctgtacggaagtgttacttctgctctaaaagctgctgcagggggggggggggggtgggggggccggttagggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtatcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaaaaaaaaaaaaaaaaaaaaaaaaaaaaaaaaaaaaaaaaaaaaaaaaaaaaaaaaaaaaaaaaagtaccttctgaggcggaaagaaccagccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcggtacccggggatcagcttgcatgcctgcagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacattctagtcgaggaattcatttatagcatagaaaaaaacaaaatgaaattctactatatttttacatacatatattctaaatatgaaagtggtgattgtgactagcgtagcatcgcttctagacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatccccgatccccgacctgcaggcatgcaagctcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 2 - DNA, 190167 bp, Vaccinia virus
  LIVP genome (reconstituted from GLV-ih68 sequence)
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 3 - DNA, 9140 bp, Vaccinia virus
  TK region in GLV-1h22
atgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggctggttctttccgcctcagaaggtactttttttttttttttttttttttttttttttttttttttttttttttttttttttttttttttttttttttttttttttttcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagatactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctcgcaaaaacagaaagaaactgctgggattccagaatatgcaaggaaagggaaagcagcattgtctaaagtgagtttctcaactttgctggcccagttgctgtcctgatatagaaattgcccagtaaccggatgcttcacattttgcattgttttctcaataagcgtatacaacagtgggctggcagaaaccttgaagttgctggtaccaagaaccgctttatccagattaatataagtgaaagcctttaaatgcagggacgaaaggtatccctctagccattcagtggcaccaaccgatccaaagtctccagcactccaactggcaaagataatgcttctgctgggctgaaacccatcttttaagaccatatctgagaacatctgggcaagtttcaataggagagctgtgcctacaccggattttgcagctccagggccccatgcatctctctgggccccaactacaacatagtgatctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcatgtccaaagaatgaaagttctgcgttaacaatgggaaatttagtctggtccatgtatatcaacacaccaattgcatttaagctttcagcatttgcaaccttttctgcaaaggtgattttccctgctctgacaatcactatagatccattcacaggagtgtataaatcctcaaaatcttttttagtaccaaaattagcatggaccagtttaccagtaactgttgcagccttactatacgccacataacccccaggattctccaccaggtaaacaagtctaccgttcttatcaactatgatcaccgagttttgagcgctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcttgatggtgctggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaacaagttagagaatgctgatctagcttgatccatcattctgaactgccacacagaagaacactagcgcgtcctccgtcccgagccgccacccgatatcccgacgctctgaggggatggcggccctaaccggcccccccaccccccccccccccctgcagcagcttttagagcagaagtaacacttccgtacaggcctagaagtaaaggcaacatccactgaggagcagttctttgatttgcaccaccaccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataa

SEQ ID NO: 4 - DNA, 3812 bp, Artificial Sequence
  pNCVVhaT
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 5 - DNA, 18 bp, Artificial Sequence
  Short non-coding DNA fragment containing HindIII and BamHI sites as contained in pNCVVhaT
taagcttcgcaggatccc

SEQ ID NO: 6 - DNA, 30 bp, Artificial Sequence
  Forward primer for amplifying left flanking DNA from the LIVP HA gene
gcgcatatgacacgattaccaatacttttg

SEQ ID NO: 7 - DNA, 41 bp, Artificial Sequence
  Reverse primer for amplifying left flanking DNA from the LIVP HA gene
gtcgggatcctgcgaagcttagatttcgaataccgacgagc

SEQ ID NO: 8 - DNA, 44 bp, Artificial Sequence
  Forward primer for amplifying right flanking DNA from the LIVP HA gene
gaaatctaagcttcgcaggatcccgactccggaaccaattactg

SEQ ID NO: 9 - DNA, 30 bp, Artificial Sequence
  Reverse primer for amplifying right flanking DNA from the LIVP HA gene
gcggaattctgatagattttactatcccag

SEQ ID NO: 10 - DNA, 3142 bp, Artificial Sequence
  pUCP7.5-gpt-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 11 - DNA, 4059 bp, Artificial Sequence
  pNCVVf14.5lT
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttcgcaggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 12 - DNA, 16 bp, Artificial Sequence
  Short non-coding DNA fragment containing Bam HI and HindIII sites as contained in pNCVVf14.5lT
aggatcctgcgaagct

SEQ ID NO: 13 - DNA, 29 bp, Artificial Sequence
  Forward primer for amplifying left flanking DNA from the LIVP 14.5L gene
gcgcatatgtagaagaattgataaatatg

SEQ ID NO: 14 - DNA, 49 bp, Artificial Sequence
  Reverse primer for amplifying left flanking DNA from the LIVP 14.5L gene
gccgcaggatcctgcgaagcttacagacacgaatatgactaaaccgatg

SEQ ID NO: 15 - DNA, 49 bp, Artificial Sequence
  Forward primer for amplifying right flanking DNA from the LIVP 14.5L gene
gtctgtaagcttcgcaggatcctgcggccgccatcgtcggtgtgttgtc

SEQ ID NO: 16 - DNA, 31 bp, Artificial Sequence
  Reverse primer for amplifying right flanking DNA from the LIVP 14.5L gene
gcggaattcagaggattacaacaaaaagatg

SEQ ID NO: 17 - DNA, 5458 bp, Artificial Sequence
  pCR-TKLR-gpt2
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 18 - DNA, 18 bp, Artificial Sequence
  Short non-coding DNA fragment containing Sac I and Bam HI sites contained in pCR-TKLR-gpt2
ggtaccgagctcggatcc

SEQ ID NO: 19 - DNA, 30 bp, Artificial Sequence
  Primer TKL-5
ataagctttgttacagatggaagggtcaaa

SEQ ID NO: 20 - DNA, 27 bp, Artificial Sequence
  Primer TKL-3
aggtaccgtttgccatacgctcacaga

SEQ ID NO: 21 - DNA, 3929 bp, Artificial Sequence
  pCR2.1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccactagtaacggccgccagtgtgctggaattcggcttaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 22 - DNA, 4412 bp, Artificial Sequence
  pCR-TKL1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggatccactagttaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 23 - DNA, 33 bp, Artificial Sequence
  Primer TKR-5 (right flank)
tgagctcggatccttctgtgagcgtatggcaaa

SEQ ID NO: 24 - DNA, 28 bp, Artificial Sequence
  Primer TKR-3 (right flank)
ttactagtacactacggtggcaccatct

SEQ ID NO: 25 - DNA, 4426 bp, Artificial Sequence
  pCR-TKR4
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 26 - DNA, 4931 bp, Artificial Sequence
  pCR-TKLR1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 27 - DNA, 20 bp, Artificial Sequence
  Primer gpt5
tcccagtcacgacgttgtaa

SEQ ID NO: 28 - DNA, 20 bp, Artificial Sequence
  Primer gpt3
tgattacgccaagctgatcc

SEQ ID NO: 29 - DNA, 40 bp, Artificial Sequence
  synthetic early/late promoter PSEL
aaaaattgaaattttattttttttttttggaatataaata

SEQ ID NO: 30 - DNA, 7251 bp, Artificial Sequence
  pSC65
agcttttgggatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatctcttggaatcaattacagatttctccgtgataggtatcgatgaaggacagttctttccagacattgttgaattagatcgataaaaattaattaattacccgggtaccaggcctagatctgtcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataacgcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtaacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgttggagtgacggcagttatctggaagatcaggatatgtggcggatgagcggcattttccgtgacgtctcgtttctgcataaaccgactacacaaatcagcgatttccatgttgccactcgctttaatgatgatttcagccgcgctgtactggaggctgaagttcagatgtgcggcgagttgcgcgactacctacgggtaacagtttctttatggcagggtgaaacgcaggtcgccagcggcaccgcgcctttcggcggtgaaattatcgatgagcgtggtggttatgccgatcgcgtcacactacgtctcaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaacctgcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgtgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattcagctgagcgccggtcgctaccattaccagttggtctggtgtcaaaaataataataaccgggcaggggggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgtttggtccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcag

SEQ ID NO: 31 - DNA, 28 bp, Artificial Sequence
  Primer SEL5
tagagctcggtttggaattagtgaaagc

SEQ ID NO: 32 - DNA, 28 bp, Artificial Sequence
  Primer SEL3
tagagctctccagacattgttgaattag

SEQ ID NO: 33 - DNA, 4095 bp, Artificial Sequence
  pCR-SEL4
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggtaccaggcctagatctgtcgacttcgagcttatttatattccaaaaaaaaaaaataaaatttcaatttttaagctttcactaattccaaaccgagctcggatccttctgtgagcgtatggcagatggtgccaccgtagtgtactagtaacggccgccagtgtgctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 34 - DNA, 62 bp, Artificial Sequence
  Primer SE5
tagagctcaaaaattgaaaaactagcgtctttttttgctcgaagtcgacagatctaggcctg

SEQ ID NO: 35 - DNA, 34 bp, Artificial Sequence
  Chemically synthesized vaccinia synthetic early promoter
aaaaattgaaaaactagcgtctttttttgctcga

SEQ ID NO: 36 - DNA, 4061 bp, Artificial Sequence
  pCR-SE1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggtaccaggcctagatctgtcgacttcgagcaaaaaaagacgctagtttttcaatttttgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 37 - DNA, 60 bp, Artificial Sequence
  Primer SL5
tagagctcttttttttttttttttttttggcatataaataagtcgacagatctaggcctg

SEQ ID NO: 38 - DNA, 32 bp, Artificial Sequence
  synthetic late promoter PSL
ttttttttttttttttttttggcatataaata

SEQ ID NO: 39 - DNA, 4059 bp, Artificial Sequence
  pCR-SL3
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggtaccaggcctagatctgtcgacttatttatatgccaaaaaaaaaaaaaaaaaaaagagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 40 - DNA, 3519 bp, Artificial Sequence
  pCR-Blunt II-TOPO
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 41 - DNA, 4222 bp, Artificial Sequence
  pNCVVhaT-SSEL-hk5
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctaaagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaaaaattgaaattttattttttttttttggaatataaataagcttaccatgtacaggatgcaactcctgtcttgcattgcactaagtcttgcacttgtcacgaattcgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattagtttttctggatccgactccggaaccaattactgataaagaagaagatcatacagtcacagacactgtctcatacactacagtaagtacatcatctggaattgtcactactaaatcaaccaccgatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 42 - DNA, 366 bp, Homo sapiens
  DNA encoding the human plasminogen kringle 5 domain
atgtacaggatgcaactcctgtcttgcattgcactaagtcttgcacttgtcacgaattcgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattag

SEQ ID NO: 43 - DNA, 4682 bp, Artificial Sequence
  pBLAST-hKringle5
ggatctgcgatcgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacgtaagtgatatctactagatttatcaaaaagagtgttgacttgtgagcgctcacaattgatacttagattcatcgagagggacacgtcgactactaaccttcttctctttcctacagctgagatcaccggcgaaggagggccaccatgtacaggatgcaactcctgtcttgcattgcactaagtcttgcacttgtcacgaattcgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattagctagctcgacatgataagatacattgatgagtttggacaaaccacaactagaatgcagtgaaaaaaatgctttatttgtgaaatttgtgatgctattgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagatcatttaaatgttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaagctgcaataaacaatcattattttcattggatctgtgtgttggttttttgtgtgggcttgggggagggggaggccagaatgactccaagagctacaggaaggcaggtcagagaccccactggacaaacagtggctggactctgcaccataacacacaatcaacaggggagtgagctggatcgagctagagtccgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagcacgtgttgacaattaatcatcggcatagtatatcggcatagtataatacgactcactataggagggccaccatgaagaccttcaacatctcccagcaggatctagaattagtagaagtagcgacagagaagattacaatgctttatgaggataataaacatcatgtgggagcggcaattcgtacgaaaacaggagaaatcatttcggcagtacatattgaagcgtatataggacgagtaactgtttgtgcagaagccattgcgattggtagtgcagtttcgaatggacaaaaggattttgacacgattgtagctgttagacacccttattctgacgaagtagatagaagtattcgagtggtaagtccttgtggtatgtgtagggagttgatttcagactatgcaccagattgttttgtgttaatagaaatgaatggcaagttagtcaaaactacgattgaagaactcattccactcaaatatacccgaaattaaaagaattcgctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgcgcagggcccaattgctcgagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 44 - DNA, 38 bp, Artificial Sequence
  Forward primer for amplifying DNA encoding the human plasminogen kringle 5 domain
gcgaagcttaccatgtacaggatgcaactcctgtcttg

SEQ ID NO: 45 - DNA, 43 bp, Artificial Sequence
  Reverse primer for amplifying DNA encoding the human plasminogen kringle 5 domain
gcgggatccagaaaaactaatcaaatgaaggggccgcacactg

SEQ ID NO: 46 - DNA, 4180 bp, Artificial Sequence
  pNCVVhaT-SEL-ADP-V5
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaaaaattgaaattttattttttttttttggaatataaataagcttaccatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtaggtaagcctatccctaaccctctcctcggtctcgattctacgtgatttttctggatccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 47 - DNA, 4348 bp, Artificial Sequence
  pNCVVhaT-ftn
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttaaaaattgaaattttattttttttttttggaatataaataccatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 48 - DNA, 498 bp, Escherichia coli
  DNA encoding E. coli ferritin (ftn)
atgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaa

SEQ ID NO: 49 - DNA, 78 bp, Artificial Sequence
  Primer 5`SSEL-ftn-VV3
aaagataagcttaaaaattgaaattttattttttttttttggaatataaataccatgctgaaaccagaaatgattgaa

SEQ ID NO: 50 - DNA, 33 bp, Artificial Sequence
  Primer 3`ftn-VV2
ataataggatccttagttttgtgtgtcgagggt

SEQ ID NO: 51 - DNA, 7983 bp, Artificial Sequence
  pCR-TK-SEL-mRFP1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacgccaccatggtgaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgcgtgggcactcagctgattcctggtgtcaccgtcttggtctacttgcctttcttccatgctttcggctttagcattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagcgctaacattcactctctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtaaagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggagaaggccggcggtggttccggagccacgaacttctctctgttaaagcaagcaggagacgtggaagaaaaccccggtcccatggcctcctccgaggacgtcatcaaggagttcatgcgcttcaaggtgcgcatggagggctccgtgaacggccacgagttcgagatcgagggagagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcctaatgaaagggcgaattctgcagatgggtaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 52 - DNA, 2370 bp, Artificial Sequence
  CBG99-2A-mRFP1 fusion protein
atggtgaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgcgtgggcactcagctgattcctggtgtcaccgtcttggtctacttgcctttcttccatgctttcggctttagcattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagcgctaacattcactctctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtaaagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggagaaggccggcggtggttccggagccacgaacttctctctgttaaagcaagcaggagacgtggaagaaaaccccggtcccatggcctcctccgaggacgtcatcaaggagttcatgcgcttcaaggtgcgcatggagggctccgtgaacggccacgagttcgagatcgagggagagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcctaa

SEQ ID NO: 53 - DNA, 5869 bp, Artificial Sequence
  CBG99-2A-mRFP1
caattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggcattccggtactgttggtaaagccaccatggtgaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgcgtgggcactcagctgattcctggtgtcaccgtcttggtctacttgcctttcttccatgctttcggctttagcattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagcgctaacattcactctctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtaaagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggagaaggccggcggtggttccggagccacgaacttctctctgttaaagcaagcaggagacgtggaagaaaaccccggtcccatggcctcctccgaggacgtcatcaaggagttcatgcgcttcaaggtgcgcatggagggctccgtgaacggccacgagttcgagatcgagggagagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcctaatgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgaggaagttcctattctctagaaagtataggaacttcgcggccgctcgcgcactactcagcgacctccaacacacaagcagggagcagatactggcttaactatgcggcatcagagcagattgtactgagagtcgaccataggggatcgggagatctcccgatccgtcgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaagaagttcctattctctagaaagtataggaacttcttaattaacggctagctgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 54 - DNA, 27 bp, Artificial Sequence
  Primer mRFP5
gtcgacgccaccatggtgaagcgtgag

SEQ ID NO: 55 - DNA, 20 bp, Artificial Sequence
  Primer mRFP3
tcattaggcgccggtggagt

SEQ ID NO: 56 - DNA, 5904 bp, Artificial Sequence
  pCRII-mRFP
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttgtcgacgccaccatggtgaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgcgtgggcactcagctgattcctggtgtcaccgtcttggtctacttgcctttcttccatgctttcggctttagcattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagcgctaacattcactctctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtaaagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggagaaggccggcggtggttccggagccacgaacttctctctgttaaagcaagcaggagacgtggaagaaaaccccggtcccatggcctcctccgaggacgtcatcaaggagttcatgcgcttcaaggtgcgcatggagggctccgtgaacggccacgagttcgagatcgagggagagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcctaatgaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 57 - DNA, 6475 bp, Artificial Sequence
  pCR-SEL-mRFP1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccatctgcagaattcgccctttcattaggcgccggtggagtggcggccctcggcgcgctcgtactgttccacgatggtgtagtcctcgttgtgggaggtgatgtccagcttgatgtcggtcttgtaggcgccgggcagctgcacgggcttcttggccatgtaggtggtcttgacctcggcgtcgtagtggccgccgtccttcagcttcagcctcatcttgatctcgcccttcagggcgccgtcctcggggtacatccgctcggtggaggcctcccagcccatggtcttcttctgcattacggggccgtcggaggggaagttggtgccgcgcagcttcaccttgtagatgaactcgccgtcctgcagggaggagtcctgggtcacggtcaccacgccgccgtcctcgaagttcatcacgcgctcccacttgaagccctcggggaaggacagcttcaagtagtcggggatgtcggcggggtgcttcacgtaggccttggagccgtactggaactgaggggacaggatgtcccaggcgaagggcagggggccgcccttggtcaccttcagcttggcggtctgggtgccctcgtaggggcggccctcgccctctccctcgatctcgaactcgtggccgttcacggagccctccatgcgcaccttgaagcgcatgaactccttgatgacgtcctcggaggaggccatgggaccggggttttcttccacgtctcctgcttgctttaacagagagaagttcgtggctccggaaccaccgccggccttctccaacaattgtttcaacagctccttgcgggtaattttgcctgttacgttacgagggatggagtcaacaaaacgcacgccgccacgcaagtacttagtatggctcacacgttcagccaggtaatcatacacttctttggcggtaatttctttaccaggctgcttgacaacgaaagcagaaggcagttcgccggcctccagatcaggaatgccgaccacagcgacatcgcgaatgcatggatttttcaacagaatctcctccaactcagctggagcaacctggctacccttgtatttgatcagctccttgtaacgatccacgacgtaaaaatgctcatcttcgtcgtaatatccaaaatcaccagaatgcaaccagccgtcgtcgtcgatggcctccttggtagcttcaacgttattgacataacccttgctcaccatagggcctttgatacacagctcgcccacttggttcgggcccaaagccttaccagtttcgcgatcagcgatcttagcagccatgagtggagtgacacggcccaaagagccgctcttaaactcatccccgagagagtgaatgttagcgctggtagattcggtgaggccgaagccacaacgaatccctggaagattcaagcgtttggcggccacttcagcgacctccttagccagtggagcggcaccgcaacacaattcacgcagtgaagacaagtcgtacttgtccacgagtgggctcttagacaaaaacaggatcacgctaggcacgttgatgacactgcggacttcataatcttggatggctttcaagaaagcctcctgatcaaaacggcggaacataatcacgcggagaccgaccataaagtaacccaaagtaatgctaaagccgaaagcatggaagaaaggcaagtagaccaagacggtgacaccaggaatcagctgagtgcccacgcgtggatcgagagcatggatcagacgcacgcaaatgttttgatgggtctgcatgactccctttgggagtccagtagtaccgctgctacacagaatggctgcaacttgttccacagggtcgaagtggagtggtttaaagtttgcgatgttgccgtctgaatagcgagagatgaaattaggcaaagattcgcaaccgtgaatattctccacagtgtccaagatgatgatacgcttaataaagttggtgcggctttggacttccaggactttgttcagaatattcttagtggtgaagacaatctgtggcttagagatacccatgactttacacagttcgtcgggaatgtagctctcgttgactggagccacgatcataccgatataccatgcggcgatgactggaatgaagaaacgggtattgttttcagcacagatactaacgacgtcgttcatcttgtagccacaattgtggagggactgagccagcaagacggttgcctcaaaaaactccttgtagctcaaagattcatcgccgaccacatcgaccaaggcttgaggcaaatgagagtgcttgcggagagcacgaaacagcatttcgccggcagtcaaatcctccaaaggatggagaggctcagggccatagatgacatttttctcacgcttcaccatggtggcgtcgacttcgagcttatttatattccaaaaaaaaaaaataaaatttcaatttttaagctttcactaattccaaaccgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 58 - DNA, 507 bp, Artificial Sequence
  A34R coding sequence from strain IHD-J
atgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatctagataccaacattaaaatgtctacagataatgcggtttatcagtgtcgtaaattacgagctagattgcctagacctgatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttgaaacagtatgtaaaagtactcaatctgtactatgtgttaaaaaattctacaagtga

SEQ ID NO: 59 - DNA, 26 bp, Artificial Sequence
  Primer A34R F
cattaataaatgaaatcgcttaatag

SEQ ID NO: 60 - DNA, 19 bp, Artificial Sequence
  Primer A34R R
ggcggcgtacgttaacgac

SEQ ID NO: 61 - DNA, 507 bp, Artificial Sequence
  A34R coding sequence from GLV-1h68
atgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtga

SEQ ID NO: 62 - DNA, 31 bp, Artificial Sequence
  IL-6 forward primer
gtcgacccaccatgctggccgtcggctgcgc

SEQ ID NO: 63 - DNA, 26 bp, Artificial Sequence
  IL-6 reverse primer
ggtaccctagagtcgcggccgcgacc

SEQ ID NO: 64 - DNA, 32 bp, Artificial Sequence
  IL-24 forward primer
gtcgaccaccatgaattttcaacagaggctgc

SEQ ID NO: 65 - DNA, 34 bp, Artificial Sequence
  IL-24 reverse primer
cccgggttatcagagcttgtagaatttctgcatc

SEQ ID NO: 66 - DNA, 31 bp, Artificial Sequence
  A34R-L Primer
atctcgagtgaggatacatggggatctgatg

SEQ ID NO: 67 - DNA, 38 bp, Artificial Sequence
  A34R-R Primer
atgagctcccgggaagcttggcggcgtacgttaacgac

SEQ ID NO: 68 - DNA, 34 bp, Artificial Sequence
  A36R-L Primer
atgagctcggatcctgcatatcagacggcaatgg

SEQ ID NO: 69 - DNA, 27 bp, Artificial Sequence
  A36R-R Primer
atgggcccatcgctatgtgctcgtcta

SEQ ID NO: 70 - DNA, 81 bp, Artificial Sequence
  Primer GM-CSF5
ctagtcgacatgtggctgcagaatttacttttcctgggcattgtggtctacagcctctcagcacccacccgctcacccatc

SEQ ID NO: 71 - DNA, 23 bp, Artificial Sequence
  Primer GM-CSF3
gggtcatttttggactggttttt

SEQ ID NO: 72 - DNA, 3910 bp, Artificial Sequence
  pPICZA-mGM-CSF
agatctaacatccaaagacgaaaggttgaatgaaacctttttgccatccgacatccacaggtccattctcacacataagtgccaaacgcaacaggaggggatacactagcagcagaccgttgcaaacgcaggacctccactcctcttctcctcaacacccacttttgccatcgaaaaaccagcccagttattgggcttgattggagctcgctcattccaattccttctattaggctactaacaccatgactttattagcctgtctatcctggcccccctggcgaggttcatgtttgtttatttccgaatgcaacaagctccgcattacacccgaacatcactccagatgagggctttctgagtgtggggtcaaatagtttcatgttccccaaatggcccaaaactgacagtttaaacgctgtcttggaacctaatatgacaaaagcgtgatctcatccaagatgaactaagtttggttcgttgaaatgctaacggccagttggtcaaaaagaaacttccaaaagtcggcataccgtttgtcttgtttggtattgattgacgaatgctcaaaaataatctcattaatgcttagcgcagtctctctatcgcttctgaaccccggtgcacctgtgccgaaacgcaaatggggaaacacccgctttttggatgattatgcattgtctccacattgtatgcttccaagattctggtgggaatactgctgatagcctaacgttcatgatcaaaatttaactgttctaacccctacttgacagcaatatataaacagaaggaagctgccctgtcttaaacctttttttttatcatcattattagcttactttcataattgcgactggttccaattgacaagcttttgattttaacgacttttaacgacaacttgagaagatcaaaaaacaactaattattcgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctgaattcgcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaaaatctagaacaaaaactcatctcagaagaggatctgaatagcgccgtcgaccatcatcatcatcatcattgagtttgtagccttagacatgactgttcctcagttcaagttgggcacttacgagaagaccggtcttgctagattctaatcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagaccttcgtttgtgcggatcccccacacaccatagcttcaaaatgtttctactccttttttactcttccagattttctcggactccgcgcatcgccgtaccacttcaaaacacccaagcacagcatactaaattttccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaatttttttttttagtttttttctctttcagtgacctccattgatatttaagttaataaacggtcttcaatttctcaagtttcagtttcatttttcttgttctattacaactttttttacttcttgttcattagaaagaaagcatagcaatctaatctaaggggcggtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtccgacggcggcccacgggtcccaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctggagaccaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagatc

SEQ ID NO: 73 - DNA, 5099 bp, Artificial Sequence
  pCRII-IL6-3
  VARIANT 1140: n= unknown
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttggtaccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 74 - DNA, 5611 bp, Artificial Sequence
  pCR-SE-IL6-7
  VARIANT 1095: n= unknown
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttcgagcaaaaaaagacgctagtttttcaatttttgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 75 - DNA, 5609 bp, Artificial Sequence
  pCR-SL-IL6-2
  VARIANT 1095: n= unknown
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttatttatatgccaaaaaaaaaaaaaaaaaaaagagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 76 - DNA, 5645 bp, Artificial Sequence
  pCR-SEL-IL6-2
  VARIANT 1095: n= unknown
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttcgagcttatttatattccaaaaaaaaaaaataaaatttcaatttttaagctttcactaattccaaaccgagctcggatccttctgtgagcgtatggcagatggtgccaccgtagtgtactagtaacggccgccagtgtgctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 77 - DNA, 5481 bp, Artificial Sequence
  HA-SE-IL6-1
  VARIANT 1622: n= unknown
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttcgagcaaaaaaagacgctagtttttcaatttttgagctcggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 78 - DNA, 5479 bp, Artificial Sequence
  HA-SL-IL6-1
  VARIANT 1622: n= unknown
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttatttatatgccaaaaaaaaaaaaaaaaaaaagagctcggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 79 - DNA, 5498 bp, Artificial Sequence
  HA-SEL-IL6-1
  VARIANT 1622: n= unknown
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttggtaccgagctctccagacattgttgaattagatcgataaaaattaattaattaccccctacatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggctcgacagaacctccacctccagaacctccacctcctcgagctggaggactcctggattctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgaccatccatgttgtgaatgtctttgaccgttcagcccgatatcngagctcaaaccgtagtctgtagaaagatgagttccaggagtgggggtcttgccaggtgacactgagccagcgggggtttctggccacggcagtgactgtgatgttggcaggcggatcaggctgcaagattccacaaccctgaaaggtttgagttttgctgaacttgctcccgacactactggcgacgcacatggacactatgtagaaagagctgtctccctccgggactgctaactggcaggagaacttctgggactcctgggaatactggcacggctcctggaagtcttcggccggactgttctgaaacttcctcaccaagagcacagcctttgtcgtcagggatggggtgctccgaggaccccactcacaaacaacattgctgagggggctcttccggaagcaggagagctggggctcctcggggggaacatccaccagcaagtgcacagtcccagctgggcggccggcccggtagcatgaatagtttccagagtcgtggagctgcaccgacctcagcagcagcctccttcccatgccagcccatctgctggggtgggagcctgcagccggcttcctgagcacccagtgaacagtggcattgtcttccggctctacccccgggcaggtcagagtcacgctgtctcctggcagactggtcagcacgcctctcgccacctcctgcgcagggcagcgccttggggccagcgccgctcccggcgcggccagcagggcagccagcagcgcgcagccgacggccagcatggtgggtcgacttcgagcttatttatattccaaaaaaaaaaaataaaatttcaatttttaagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 80 - DNA, 4162 bp, Artificial Sequence
  pCRII-IL24-3
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttgtcgaccaccatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgataacccgggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 81 - DNA, 4676 bp, Artificial Sequence
  pCR-SE-IL24-2
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttcgagcaaaaaaagacgctagtttttcaatttttgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 82 - DNA, 4674 bp, Artificial Sequence
  pCR-SL-IL24-2
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttatttatatgccaaaaaaaaaaaaaaaaaaaagagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 83 - DNA, 4710 bp, Artificial Sequence
  pCR-SEL-IL24-2
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttcgagcttatttatattccaaaaaaaaaaaataaaatttcaatttttaagctttcactaattccaaaccgagctcggatccttctgtgagcgtatggcagatggtgccaccgtagtgtactagtaacggccgccagtgtgctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 84 - DNA, 4793 bp, Artificial Sequence
  FSE-IL24-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttcgagcaaaaaaagacgctagtttttcaatttttgagctcggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 85 - DNA, 4791 bp, Artificial Sequence
  FSL-IL24-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttatttatatgccaaaaaaaaaaaaaaaaaaaagagctcggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 86 - DNA, 4810 bp, Artificial Sequence
  FSEL-IL24-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagacattgttgaattagatcgataaaaattaattaattacccgggttatcagagcttgtagaatttctgcatccaggtcagaagaatgtccacttccccaagggctttggtcagagctgcttctacgtccaactgtttgaatgctctccggaatagcagaaaccgcctgtgtgcactgtctctgatggaaaacatctcattttcttgactgggttgcagttgtgacacgatgagaacaaagttgttggccagagtagagaatgacttcagagtcctgacttcaactgttctattgtggtagtttttgaaaacagttttcaagtagaactccagcagggtgtggacaaggtaacagctctcagcatccgagacgttctgcagaacctcctgctgcagcagccgggcactcgtgatgttatcctgagcttgcatagtgtctttcacagcccagaaggcttcccacagtttctggggaacaacccccttcacttggcagggcccaaagtggaattcttggccctgggcccctgatacctggctccagagaagcagggtaaaacccaggcaagggagcacaaccatctgcatttgagaggctgtcgccagcaaaggagggcagaagggtctgctggctaaagtccacaggctttgcagcctctgttgaaaattcatggtggtcgacttcgagcttatttatattccaaaaaaaaaaaataaaatttcaatttttaagcttcgcaggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 87 - DNA, 4972 bp, Artificial Sequence
  pCRII-dA35R-1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttatgggcccatcgctatgtgctcgtctaaacggattattctcactaaatttattgttaagttctgtaataaacggatttgacttgctacaaatactggttttattataatttacgaaaggattggatgaatagttaggattctgtttggtatcttcattaagtacttcaacagtctccgtttcattaattactactgtagtgttctgataaatagtctgttcattacgatcattatttattagcagcgtgcttccagcaacactatcgtaaatgtgttctgtgctaggcgccataacattggattcgttatcccatattaaactaccagcgaagctatcatcgtccaatatctcattcctagaaatattatctacgtcattgttttgttccatagcactacagtgatcctcccagtctgattcgctatcagttgatttactagatttgctggaattagaactctttatcttttttaattttgtcatgataattttattgtcattatagacagtacgtatctttttcctacaaatatataatatataacatactaatattgttcccgcaactacggtcaccgtgataagaggtaccagcatcatttctgattgctcaatatacgtactactagttcaatatttattgttttattatttactttacaacttttatgataaaaaattactattgcatttcccatcaattatgatccatccattgccgtctgatatgcaggatccgagctcccgggaagcttggcggcgtacgttaacgacttattattaattcattttttgttgtcacttgtagaattttttaacacatagtacagattgagtacttttacatactgttttaaccagttttccagacttgtatatataacacgcttcagcatccgtcgtactgtttagttgtttaaaatttgttaatttactaatatctatatctttatcattattaatatctaaccatttatcattggtcttttttaaacttacccaataatctttataaaaaatactaaacaatactctcagatgtctagtatcaggtctaggcaatctagctcgtaatttacgacactgataaaccgcattatctgtagacattttaatgttagtatctaaataacaatgtttatcgtattgtatccatccattggcgcaagcactaggcatcagttcttctttgtaatgcagaaatgttcctatgccactaataatggttgagagtatcatcattatagcggccggcaccgacaacttcttaaacctacttacagtttgtctattaagcgatttcatttattaatgtacaaaaataaatattagttcattgttttaacacaaaaatactttctaacttcttgtgatacatcagaatcttgataatcggatgtagtttttgtaattggattaccatcagatccccatgtatcctcactcgagataagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 88 - DNA, 4420 bp, Artificial Sequence
  pCR-dTK-gpt1
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagtaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 89 - DNA, 5845 bp, Artificial Sequence
  pCR-gpt-dA35R-6
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagtaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagtgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccaagcttcccgggagctcggatcctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 90 - protein, 13 aa, Artificial Sequence
  sIL-6R Linker Sequence
RGGGGSGGGGSVE

SEQ ID NO: 91 - DNA, 27 bp, Artificial Sequence
  hu-tTF-RGDrev-cDNA primer
ctttctacacttgtgtagagatatagc

SEQ ID NO: 92 - DNA, 960 bp, Artificial Sequence
  tTF-RGD cDNA
ctttctacacttgtgtagagatatagccaggatgatgacaaggatgatgaccacaaataccacagctccaatgatgtagaatatttctctgaattcccctttctcctggcccatacactctaccgggctgtctgtactcttccggttaactgttcgggagggaatcactgcttgaacactgaaacagtagttttctcctttatccacatcaatcaaaaactcattagtgtttgttttggctgttttctttcctgaacttgaagatttccaataataaagtgtataaattaagtccttgccaaaaacatcccggaggcttaggaaagtgttgttccttctgactaaagtccgttcatcttctacggtcacattcacttttgttcccacctgttcaaaactctgaattgttggctgtccgaggtttgtctccaggtaaggtgtgaactctggggagttctcatacagaggctccccagcagaaccggtgctctccacattccctgccgggtaggagaagacccgtgccaagtacgtctgcttcacatccttcacaatctcgtcggtgaggtcacactctgtgtctgttgtgtaaaagcatttgcttttccaatctcctgacttagtgcttatttgaacagtgtagacttgattgacgggtttgggttcccactccaaaattgtcttgaaattagttgatttccaagttaaattatatgctgccacagtatttgtagtgcctgaagcgccggccacctgggcgaagacccagccgagcaggagcgtccgagcgacggcggtctcggggcgcgggacccggggccaggcaggggtctccatgtctaccagttggcggcgagatcgagcgggttccgtggcgcccgtggggctggggaggttgggctgaaggcgccctgggccggccagagggagtgcgagggggtgcggggagctcgcagtctt

SEQ ID NO: 93 - protein, 264 aa, Artificial Sequence
  tTF-RGD protein
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRGRGDSPDYKDDDDK

SEQ ID NO: 94 - DNA, 4311 bp, Artificial Sequence
  pCRII-tTF-RGD vector
aagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaattaatattatggagaatcacctcttcctctgaattcccctttctcctggcccatacactctaccgggctgtctgtactcttccggttaactgttcgggagggaatcactgcttgaacactgaaacagtagttttctcctttatccacatcaatcaaaaactcattagtgtttgttttggctgttttctttcctgaacttgaagatttccaataataaagtgtataaattaagtccttgccaaaaacatcccggaggcttaggaaagtgttgttccttctgactaaagtccgttcatcttctacggtcacattcacttttgttcccacctgttcaaaactctgaattgttggctgtccgaggtttgtctccaggtaaggtgtgaactctggggagttctcatacagaggctccccagcagaaccggtgctctccacattccctgccgggtaggagaagacccgtgccaagtacgtctgcttcacatccttcacaatctcgtcggtgaggtcacactctgtgtctgttgtgtaaaagcatttgcttttccaatctcctgacttagtgcttatttgaacagtgtagacttgattgacgggtttgggttcccactccaaaattgtcttgaaattagttgatttccaagttaaattatatgctgccacagtatttgtagtgcctgaagcgccggccacctgggcgaagacccagccgagcaggagcgtccgagcgacggcggtctcggggcgcgggacccggggccaggcaggggtctccatggtgggtcgac

SEQ ID NO: 95 - DNA, 6321 bp, Artificial Sequence
  pCR-TK-SE-tTF-RGD vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgacccaccatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagaggaagaggtgattctccataatattaat

SEQ ID NO: 96 - DNA, 6357 bp, Artificial Sequence
  pCR-TK-SEL-tTF-RGD vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacccaccatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagaggaagaggtgattctccataatattaat

SEQ ID NO: 97 - DNA, 6320 bp, Artificial Sequence
  pCR-TK-SL-tTF-RGD vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacccaccatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagaggaagaggtgattctccataatattaat

SEQ ID NO: 98 - DNA, 3717 bp, Artificial Sequence
  pGA4-G6 vector
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggctatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgagactacaaggatgacgacgacaagtaattaattaagagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 99 - protein, 272 aa, Artificial Sequence
  G6-FLAG protein sequence
METDTLLLWVLLLWVPGSTGDEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQGYGNPFTFGQGTKVEIKRDYKDDDDK

SEQ ID NO: 100 - DNA, 6367 bp, Artificial Sequence
  pCR-TK-SE-G6-FLAG vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgagactacaaggatgacgacgacaagtaattaat

SEQ ID NO: 101 - DNA, 6403 bp, Artificial Sequence
  pCR-TK-SEL-G6-FLAG vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgagactacaaggatgacgacgacaagtaattaat

SEQ ID NO: 102 - DNA, 6366 bp, Artificial Sequence
  pCR-TK-SL-G6-FLAG vector
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgagactacaaggatgacgacgacaagtaattaat

SEQ ID NO: 103 - DNA, 7082 bp, Artificial Sequence
  pcDNA-RG vector
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 104 - DNA, 5775 bp, Artificial Sequence
  pF14.5-SEL-RG vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttaaaaattgaaattttattttttttttttggaatataaatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgaaagggcgaattctgcagatgatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 105 - DNA, 5230 bp, Artificial Sequence
  pCRII-SEL-RG
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttatcaagcttaaaaattgaaattttattttttttttttggaatataaatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 106 - DNA, 1572 bp, Artificial Sequence
  sIL-6R/IL-6 fusion cDNA
  VARIANT 766: n= unknown
atgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcngatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctcgaggaggtggaggttctggaggtggaggttctgtcgagccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcac

SEQ ID NO: 107 - DNA, 624 bp, Artificial Sequence
  IL-24 cDNA
atgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctga

SEQ ID NO: 108 - DNA, 3956 bp, Artificial Sequence
  pCRII-CSF9 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgccctttagtcgacatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgacccaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 109 - DNA, 4482 bp, Artificial Sequence
  SE-CSF-2 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccaattcgcccttgggtcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatgtcgacttcgagcaaaaaaagacgctagtttttcaatttttgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 110 - DNA, 5990 bp, Artificial Sequence
  TK-SE-CSF-2 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgaagtcgacatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgacccaagggcgaattgggtaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 111 - DNA, 4517 bp, Artificial Sequence
  SEL-CSF-2 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccaattcgcccttgggtcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatgtcgacttcgagcttatttatattccaaaaaaaaaaaataaaatttcaatttttaagctttcactaattccaaaccgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 112 - DNA, 6027 bp, Artificial Sequence
  TK-SEL-CSF-2 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaaataagctcgaaagtcgacatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgacccaagggcgaattgggtaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 113 - DNA, 4480 bp, Artificial Sequence
  SL-CSF-3 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccaattcgcccttgggtcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatgtcgacttatttatatgccaaaaaaaaaaaaaaaaaaaagagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 114 - DNA, 5988 bp, Artificial Sequence
  TK-SL-CSF-3 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgacccaagggcgaattgggtaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 115 - DNA, 28 bp, Artificial Sequence
  hu-tTF-RGD forward primer (SalI)
gtcgacccaccatggagacccctgcctg

SEQ ID NO: 116 - DNA, 53 bp, Artificial Sequence
  hu-tTF-RGD reverse primer (PacI)
ttaattaatattatggagaatcacctcttcctctgaattcccctttctcctgg

SEQ ID NO: 117 - DNA, 74 bp, Artificial Sequence
  ruc-gfp Psel forward primer
atcaagcttaaaaattgaaattttattttttttttttggaatataaatgacttcgaaagtttatgatccagaac

SEQ ID NO: 118 - DNA, 20 bp, Artificial Sequence
  ruc-gfp reverse primer
tcacttgtacagctcgtcca

What is claimed:

1. A recombinant replication competent Lister strain vaccinia virus that encodes a diagnostic or therapeutic protein that comprises an anti-vascular endothelial (VEGF) single chain antibody, and that comprises an inactivated hemagglutinin (HA) gene, thymidine kinase (TK) gene or F14.5L gene.

2. A recombinant Lister strain vaccinia virus of claim 1, comprising, an inactivated hemagglutinin (HA) gene, thymidine kinase (TK) gene, and F14.5L gene or locus, wherein
   the Lister strain vaccinia virus is an LIVP strain of virus; and
   the DNA encoding the protein comprising an anti-VEGF single chain antibody is inserted into one or more of a gene locus selected from among the HA gene locus, TK gene locus and the F14.5L gene locus in the Lister strain vaccinia virus.

3. The recombinant Lister strain vaccinia virus of claim 1 selected from among GLV-1h107, GLV-1h108 and GLV-1h109.

4. A recombinant Lister strain vaccinia virus of claim 1 that comprises replacement of the A34R gene with the A34R gene from another vaccinia virus strain.

5. The recombinant Lister strain vaccinia virus of claim 4, wherein the A34R gene is replaced by the A34R gene from vaccinia IHD-J strain.

6. The recombinant Lister strain vaccinia virus of claim 4, wherein the replacement increases the extracellular enveloped virus (EEV) form of vaccinia virus and/or increases the resistance of the virus to virus neutralizing antibodies.

7. A recombinant Lister strain vaccinia virus of claim 1 that comprises deletion of the A35R gene.

8. The recombinant Lister stain vaccinia virus of claim 1 that is an LIVP strain.

9. A recombinant Lister strain virus of claim 1, further comprising one or more heterologous nucleic acid molecules that encode(s) a diagnostic protein and/or another therapeutic gene product.

10. The recombinant Lister strain virus of claim 9, further comprising a nucleic acid molecule that encodes a diagnostic protein that is a detectable protein or a protein that induces a detectable signal.

11. The recombinant Lister strain virus of claim 10, wherein the diagnostic protein is selected from among a luciferase, a fluorescent protein, an iron storage molecule, an iron transporter, an iron receptor or a protein that binds a contrasting agent, chromophore or a compound or detectable ligand that can be detected.

12. The recombinant Lister strain virus of claim 9, wherein the therapeutic gene product is selected from among a cytokine, a chemokine, an immunomodulatory molecule, an antigen, a single chain antibody, antisense RNA, prodrug converting enzyme, siRNA, angiogenesis inhibitor, a toxin, an antitumor oligopeptide, a mitosis inhibitor protein, an antimitotic oligopeptide, an anti-cancer polypeptide antibiotic and tissue factor.

13. A combination, comprising a recombinant Lister strain vaccinia virus of claim 1 and an anticancer compound.

14. The combination of claim 13, wherein the anti-cancer compound is selected from among a cytokine, a chemokine, a growth factor, a photosensitizing agent, a toxin, an anti-cancer antibiotic, a chemotherapeutic compound, a radionuclide, an angiogenesis inhibitor, a signaling modulator, an antimetabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, a bacterium and a combination of any of the preceding thereof.

15. The combination of claim 13, wherein the anti-cancer compound is selected from among cisplatin, carboplatin, gemcitabine, irinotecan, an anti-EGFR antibody and an anti-VEGF antibody.

16. The combination of claim 13, wherein the anti-cancer compound and virus are formulated as a single composition or separately in two compositions.

17. A kit, comprising the combination of claim 13; and optional instructions for administration of the composition(s).

18. A pharmaceutical composition comprising a recombinant Lister strain vaccinia virus of claim 1 in a pharmaceutically acceptable carrier.

19. The pharmaceutical composition of claim 18 that is formulated for local or systemic administration.

20. The pharmaceutical composition of claim 18, comprising two or more viruses.

21. A combination, comprising:
   a recombinant Lister strain vaccinia virus of claim 1; and
   an anticancer compound selected from among cisplatin, carboplatin, gemcitabine, irinotecan, an anti-EGFR antibody and an anti-VEGF antibody.

22. The combination of claim 21, wherein the Lister strain vaccinia virus is an LIVP strain vaccinia virus.

23. The combination of claim 22, wherein the Lister strain vaccinia virus is selected from among GLV-1h107, GLV-1h108 and GLV-1h109.

24. The combination of claim 21, wherein the Lister strain vaccinia virus and the anti-cancer compound are formulated as a single composition or separately in two compositions.

25. The combination of claim 21, further comprising a pharmaceutically acceptable carrier.

26. An isolated cell containing a recombinant Lister strain vaccinia virus of claim 1.

27. An isolated tumor cell containing a recombinant Lister strain vaccinia virus of claim 1.

28. The combination of claim 13, wherein the anti-cancer compound is selected from among dacarbazine, vincristine and mitomycin.

29. The recombinant Lister strain vaccinia virus of claim 2, wherein the LIVP strain prior to insertion of the heterologous nucleic acid is GLV-1h68.

30. The recombinant Lister strain vaccinia virus of claim 1, wherein the anti-VEGF single chain antibody is antibody G6.

31. The recombinant Lister strain vaccinia virus of claim 1, wherein the anti-VEGF single chain antibody is encoded as a FLAG fusion protein.

32. The recombinant Lister strain vaccinia virus of claim 1, wherein expression of the protein comprising an anti-VEGF single chain antibody is under the control of a vaccinia early promoter, vaccinia early/late promoter or vaccinia late promoter.

33. A recombinant Lister strain vaccinia virus of claim 1, comprising an inactivated hemagglutinin (HA) gene, thymidine kinase (TK) gene, and F14.5L gene or locus.

34. A recombinant oncolytic vaccinia virus, comprising, an inactivated hemagglutinin (HA) gene, thymidine kinase (TK) gene, and F14.5L gene or locus, wherein the virus encodes a protein comprising an anti-VEGF single chain antibody.

* * * * *

UNITED STATES PATENT AND TRADEMARK OFFICE
CERTIFICATE OF CORRECTION

PATENT NO. : 8,052,968 B2  
APPLICATION NO. : 11/975090  
DATED : November 8, 2011  
INVENTOR(S) : Szalay et al.

Page 1 of 2

It is certified that error appears in the above-identified patent and that said Letters Patent is hereby corrected as shown below:

IN THE TITLE PAGES:

In Item (12):
　　please replace "Chen et al.," with --Szalay et al.,--
In Item (75)
　　please replace "Nanhai Chen, San Diego, CA (US); Alexa Frentzen, San Diego, CA (US); Aladar A. Szalay, Highland, CA (US); Yong A. Yu, San Diego, CA (US); Qian Zhang, San Diego, CA (US)" with --Aladar A. Szalay, Highland, CA (US); Alexa Frentzen, San Diego, CA (US); Yong A. Yu, San Diego, CA (US); Nanhai Chen, San Diego, CA (US); Qian Zhang, San Diego, CA(US)--.

IN THE SPECIFICATION:

At Column 80, lines 27, please replace "a catheter (tube) put is inserted into the" with --a catheter (tube) is inserted into the--

IN THE CLAIMS:

Column 175, line 62 to Column 175, line 63 should read
8.　　The recombinant Lister strain vaccinia virus of claim 1 that is an LIVP strain.

Column 175, line 64 to Column 175, line 67 should read
9.　　A recombinant Lister strain vaccinia virus of claim 1, further comprising one or more heterologous nucleic acid molecules that encode(s) a diagnostic protein and/or another therapeutic gene product.

Column 176, line 31 to Column 176, line 34 should read
10.　　The recombinant Lister strain vaccinia virus of claim 9, further comprising a nucleic acid molecule that encodes a diagnostic protein that is a detectable protein or a protein that induces a detectable signal.

Signed and Sealed this  
Twentieth Day of March, 2012

David J. Kappos  
*Director of the United States Patent and Trademark Office*

CERTIFICATE OF CORRECTION (continued)
U.S. Pat. No. 8,052,968 B2

Column 176, line 35 to Column 176, line 40 should read
11. The recombinant Lister strain vaccinia virus of claim 10, wherein the diagnostic protein is selected from among a luciferase, a fluorescent protein, an iron storage molecule, an iron transporter, an iron receptor or a protein that binds a contrasting agent, chromophore or a compound or detectable ligand that can be detected.

Column 176, line 41 to Column 176, line 48 should read
12. The recombinant Lister strain vaccinia virus of claim 9, wherein the therapeutic gene product is selected from among a cytokine, a chemokine, an immunomodulatory molecule, an antigen, a single chain antibody, antisense RNA, prodrug converting enzyme, siRNA, angiogenesis inhibitor, a toxin, an antitumor oligopeptide, a mitosis inhibitor protein, an antimitotic oligopeptide, an anti-cancer polypeptide antibiotic and tissue factor.

UNITED STATES PATENT AND TRADEMARK OFFICE
CERTIFICATE OF CORRECTION

PATENT NO. : 8,052,968 B2  
APPLICATION NO. : 11/975090  
DATED : November 8, 2011  
INVENTOR(S) : Szalay et al.

Page 1 of 1

It is certified that error appears in the above-identified patent and that said Letters Patent is hereby corrected as shown below:

IN THE SPECIFICATION:

At column 38, line 59, please replace "pseudomonas A endotoxin" with --Pseudomonas exotoxin--

Signed and Sealed this  
Seventeenth Day of September, 2013

Teresa Stanek Rea  
*Deputy Director of the United States Patent and Trademark Office*